US012065479B2

(12) United States Patent
Choe et al.

(10) Patent No.: US 12,065,479 B2
(45) Date of Patent: Aug. 20, 2024

(54) FORCE SENSOR CLEAVAGE DOMAIN CONTAINING CHIMERIC POLYPEPTIDES AND METHODS OF USE THEREOF

(71) Applicants: The Regents of the University of California, Oakland, CA (US); The Trustees of Columbia University in the City of New York, New York, NY (US)

(72) Inventors: Joseph H. Choe, San Francisco, CA (US); Paul Langridge, New York, NY (US); Wendell A. Lim, San Francisco, CA (US); Kole T. Roybal, San Francisco, CA (US); Gary Struhl, New York, NY (US)

(73) Assignees: THE REGENTS OF THE UNIVERSITY OF CALIFORNIA, Oakland, CA (US); THE TRUSTEES OF COLUMBIA UNIVERSITY IN THE CITY OF NEW YORK, New York, NY (US)

( * ) Notice: Subject to any disclaimer, the term of this patent is extended or adjusted under 35 U.S.C. 154(b) by 974 days.

(21) Appl. No.: 16/763,524

(22) PCT Filed: Nov. 15, 2018

(86) PCT No.: PCT/US2018/061307
§ 371 (c)(1),
(2) Date: May 12, 2020

(87) PCT Pub. No.: WO2019/099689
PCT Pub. Date: May 23, 2019

(65) Prior Publication Data
US 2020/0331985 A1 Oct. 22, 2020

Related U.S. Application Data

(60) Provisional application No. 62/588,079, filed on Nov. 17, 2017, provisional application No. 62/587,296, filed on Nov. 16, 2017.

(51) Int. Cl.
| | | |
|---|---|---|
| C07K 14/755 | (2006.01) | |
| C07K 14/59 | (2006.01) | |
| C07K 14/705 | (2006.01) | |
| C07K 14/72 | (2006.01) | |
| C07K 16/28 | (2006.01) | |
| G01N 33/50 | (2006.01) | |
| G01N 33/68 | (2006.01) | |

(52) U.S. Cl.
CPC ............ *C07K 14/755* (2013.01); *C07K 14/59* (2013.01); *C07K 14/705* (2013.01); *C07K 14/723* (2013.01); *C07K 16/28* (2013.01); *G01N 33/5005* (2013.01); *G01N 33/6803* (2013.01); *C07K 2317/54* (2013.01); *C07K 2317/55* (2013.01); *C07K 2317/622* (2013.01); *C07K 2317/626* (2013.01); *C07K 2319/02* (2013.01); *C07K 2319/03* (2013.01); *C07K 2319/50* (2013.01); *C07K 2319/60* (2013.01)

(58) Field of Classification Search
None
See application file for complete search history.

(56) References Cited

U.S. PATENT DOCUMENTS

| 10,590,182 B2* | 3/2020 | Lim | ................... C07K 16/2803 |
|---|---|---|---|
| 10,822,387 B2* | 11/2020 | Lim | ................... C07K 16/2803 |
| 10,836,808 B2* | 11/2020 | Lim | ........................ A61K 48/00 |
| 2016/0115217 A1 | 4/2016 | Kitajewski et al. | |
| 2016/0264665 A1 | 9/2016 | Lim et al. | |

FOREIGN PATENT DOCUMENTS

| JP | 2011188821 A | 9/2011 | |
|---|---|---|---|
| WO | WO 2008/057144 A2 | 5/2008 | |
| WO | WO 2016/138034 A1 | 9/2016 | |
| WO | WO-2016138034 A1 * | 9/2016 | ............. A61K 35/17 |
| WO | WO 2017/123559 A2 | 7/2017 | |

OTHER PUBLICATIONS

Gordon et al., Dev Cell . Jun. 22, 2015;33(6):729-36. doi: 10.1016/j.devcel.2015.05.004. Epub Jun. 4, 2015. PMID: 26051539 PMCID: PMC4481192.*
Buchanan et al., Proc Natl Acad Sci U S A . Oct. 12, 2010;107(41):17774-9. doi: 10.1073/pnas.1013105107. Epub Sep. 27, 2010. PMID: 20876099 PMCID: PMC2955128.*
Morsut et al., Cell. Feb. 11, 2016;164(4):780-91. doi: 10.1016/j.cell.2016.01.012. Epub Jan. 28, 2016. PMID: 26830878.*

(Continued)

*Primary Examiner* — Michael Szperka
(74) *Attorney, Agent, or Firm* — James S. Keddie; Bozicevic, Field & Francis LLP

(57) ABSTRACT

Provided are chimeric polypeptides which modulate various cellular processes following cleavage of a force sensor cleavage domain, including non-Notch force sensor cleavage domains, induced upon binding of a specific binding member of the chimeric polypeptide with its binding partner. Methods of using force sensor cleavage domain-containing chimeric polypeptides to modulate cellular functions, including e.g., modulation (including induction or repression) of gene expression, are also provided. Nucleic acids encoding the subject chimeric polypeptides and associated expression cassettes and vectors as well as cells that contain such nucleic acids and/or expression cassettes and vectors are provided. Also provided, are methods of monitoring cell-cell signaling and method of treating a subject using the described components, as well as kits for practicing the subject methods.

22 Claims, 14 Drawing Sheets

Specification includes a Sequence Listing.

(56) References Cited

OTHER PUBLICATIONS

Gordon et al., Dev Cell. Jun. 22, 2015;33(6):729-36. doi: 10.1016/j.devcel.2015.05.004. Epub Jun. 4, 2015. PMID: 26051539.*

Attwood et al., Science. Oct. 20, 2000;290(5491):471-3. doi: 10.1126/science.290.5491.471. PMID: 11183771.*

Skolnick et al., Trends Biotechnol. Jan. 2000;18(1):34-9. doi: 10.1016/s0167-7799(99)01398-0. PMID: 10631780.*

Roybal et al., "Engineering T Cells with Customized Therapeutic Response Programs Using Synthetic Notch Receptors", Cell, 2016; 167 (2): 419-432.

Roybal et al., "Synthetic immunology: Hacking immune cells to expand their therapeutic capabilities", Annual Review of Immunology, Jan. 2017; 35: 229-253.

Hayward et al., "Harnessing Notch signaling to decode mechanisms of proteolytic regulation in diverse cell-surface receptors", bioRxiv, 2018; XP055849739, URL: https://www.biorxiv.org/content/10.1101/436592v1.full.pdf.

Jakobi et al., "Calcium modulates force sensing by the von Willebrand factor A2 domain", Nature Communications, 2011, 2: 385.

Langridge et al., "Activation of Notch by mechanical force in vivo", Poster presented at the 58th Annual *Drosophila* Research Conference, No. 728B, Mar. 29, 2017.

Langridge et al., "Why is Epsin-dependent endocytosis of ligand required to activate Notch?", Poster presented at the EMBO Endocytic Trafficking and Signaling in Health and Disease Conference, Sep. 14, 2017.

Langridge et al., "Epsin-mediated endocytosis of DSL-ligands in vivo is required after ligand-receptor engagement to exert force on the receptor", Poster presented at the Gordon Research Conference on Notch Signaling in Development, Regeneration and Disease, Aug. 1, 2016.

Lister et al., "Ligand-modulated conformational switching in a fully synthetic membrane-bound receptor", Nature Chemistry, 2017, 9(5): 420-425.

Feng et al., "The Interaction between Factor H and Von Willebrand Factor", PLoS ONE, 2013, 8(8): e73715.

Roybal et al., "Precision Tumor Recognition by T Cells With Combinatorial Antigen Sensing Circuits", Cell, 2016, 164 (4): 770-779.

Buchanan et al., "Proteolytic processing of protocadherin proteins requires endocytosis", PNAS, 2010, 107(41): 17774-17779.

Gordon et al., "Mechanical Allostery: Evidence for a Force Requirement in the Proteolytic Activation of Notch", Developmental Cell, 2015, 33: 729-736.

Langridge et al., "Epsin-Dependent Ligand Endocytosis Activates Notch by Force", Cell, 2017, 171: 1383-1396.

Morsut et al., "Engineering Customized Cell Sensing and Response Behaviors Using Synthetic Notch Receptors", Cell, 2016, 164: 780-791.

Pruss et al., "Use of a mouse model to elucidate the phenotypic effects of the von Willebrand factor cleavage mutants, Y1605A/M1606A and R1597W", Journal of Thrombosis and Haemostasis, 2012, 10(5): 940-950.

Xu et al., "Mechanisms by which von Willebrand Disease Mutations Destabilize the A2 Domain", The Journal of Biological Chemistry, 2013, 288(9): 6317-6324.

* cited by examiner

FIG. 1A
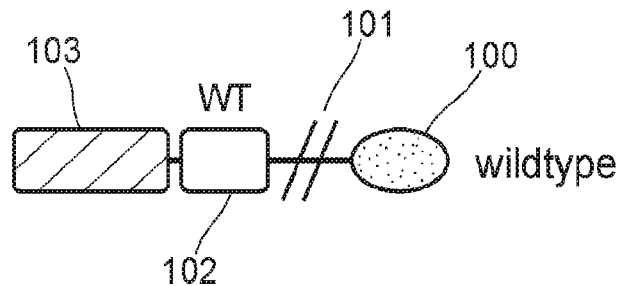
FIG. 1B
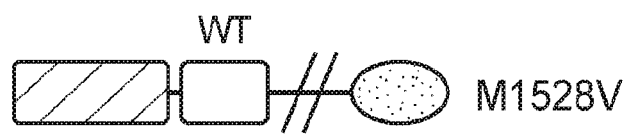
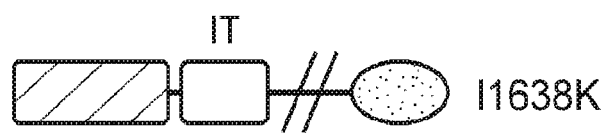
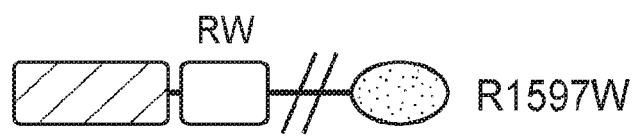
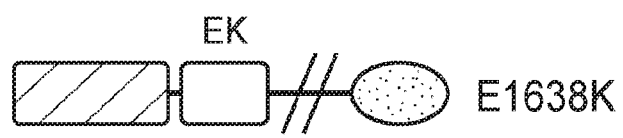
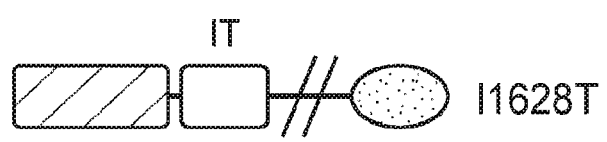

FIG. 2B
wildtype
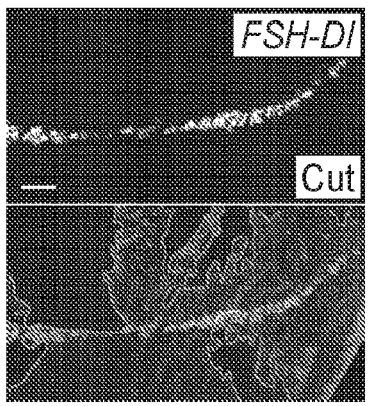
M1528V
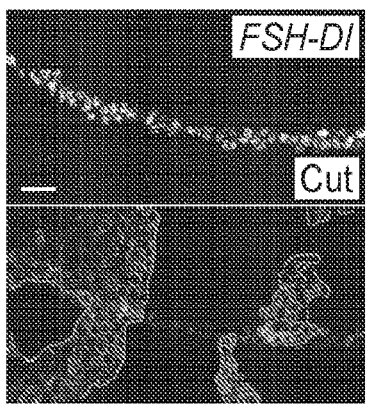
FIG. 2C
R1597W
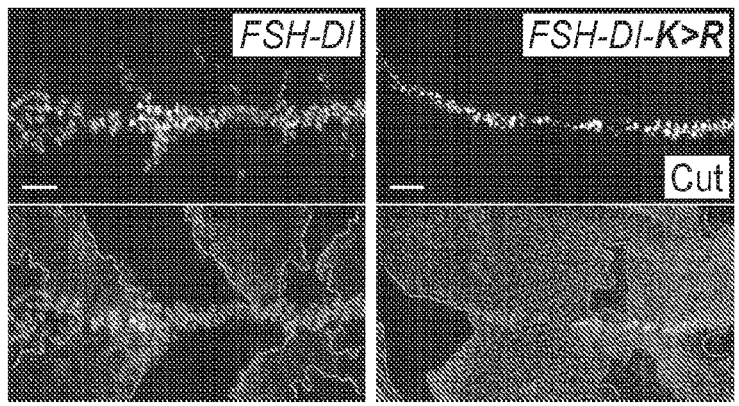
I1628T
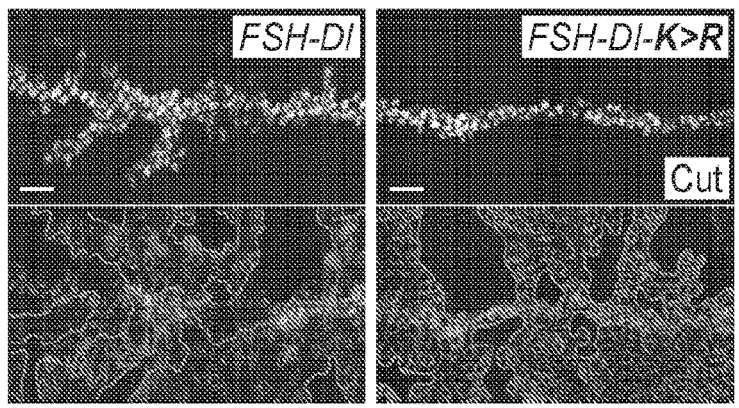
FIG. 2D
E1638K no FSHα
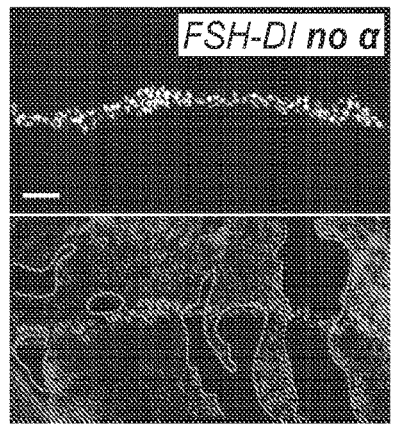

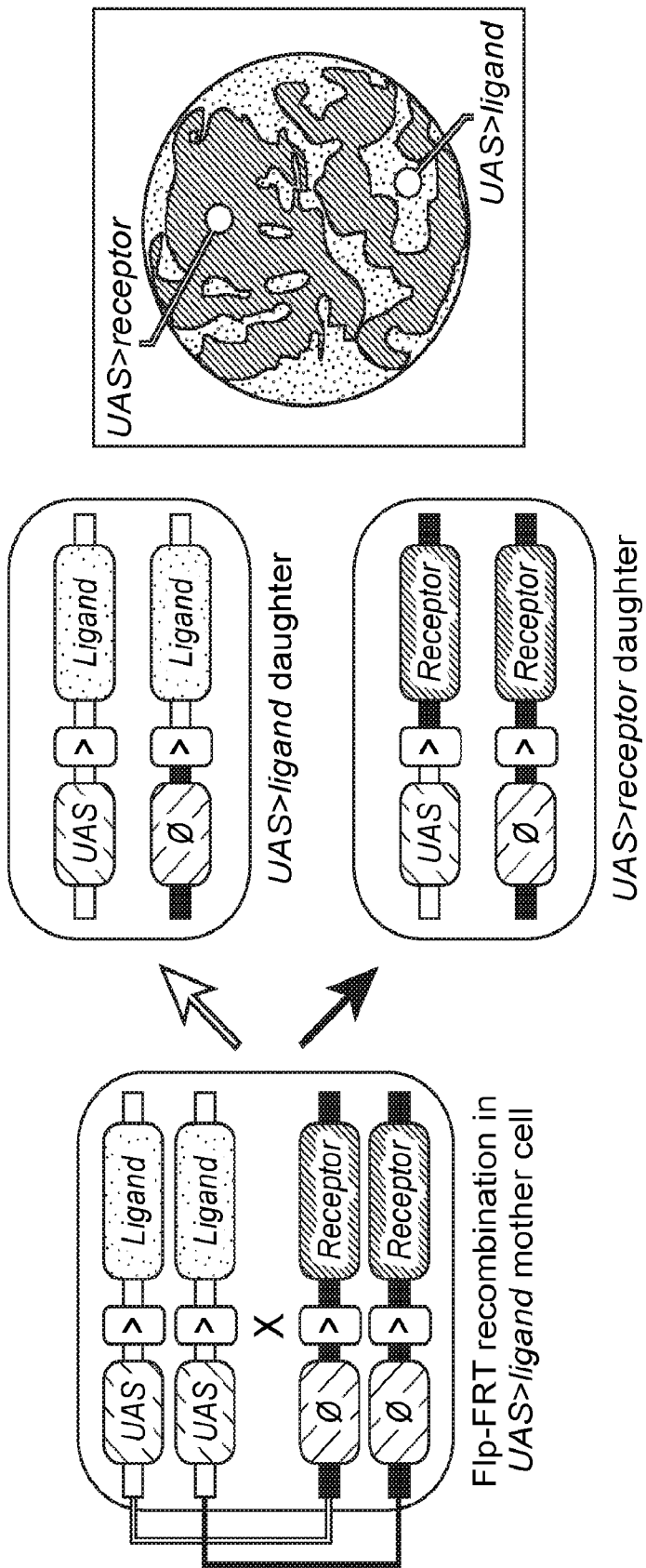

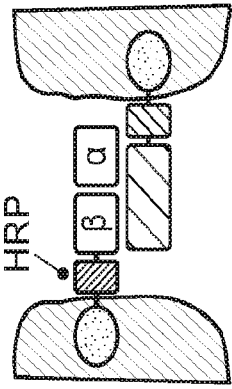
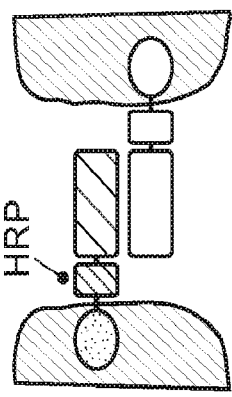
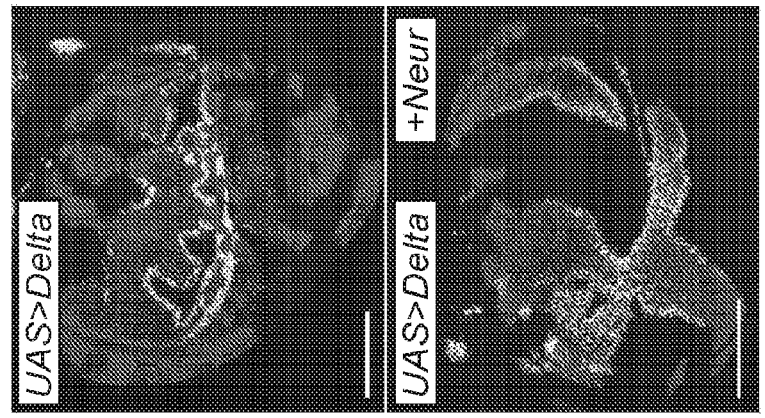
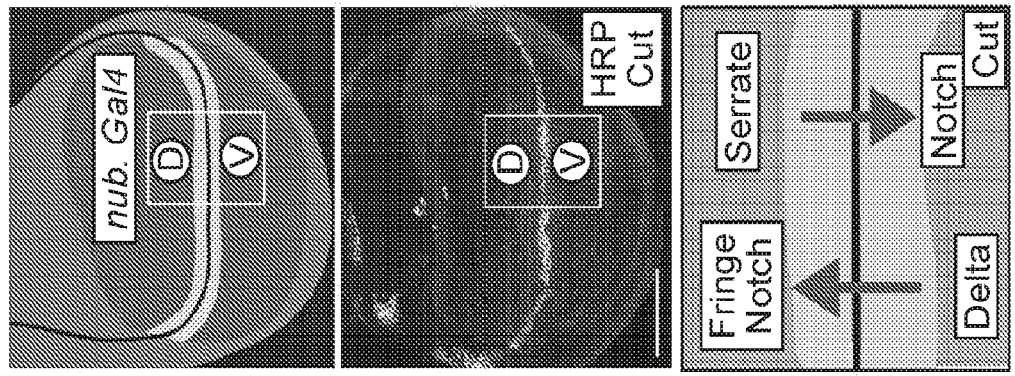

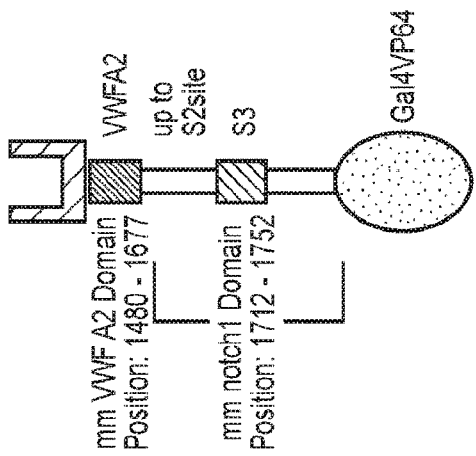
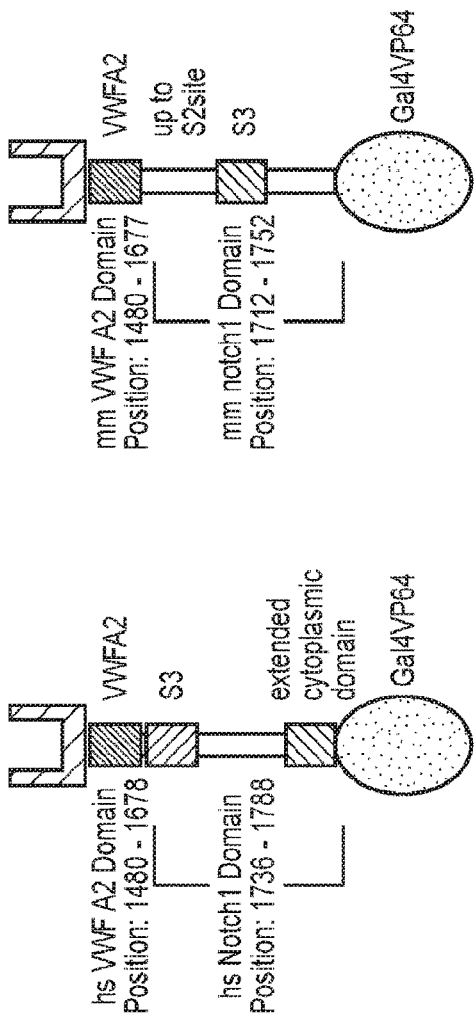
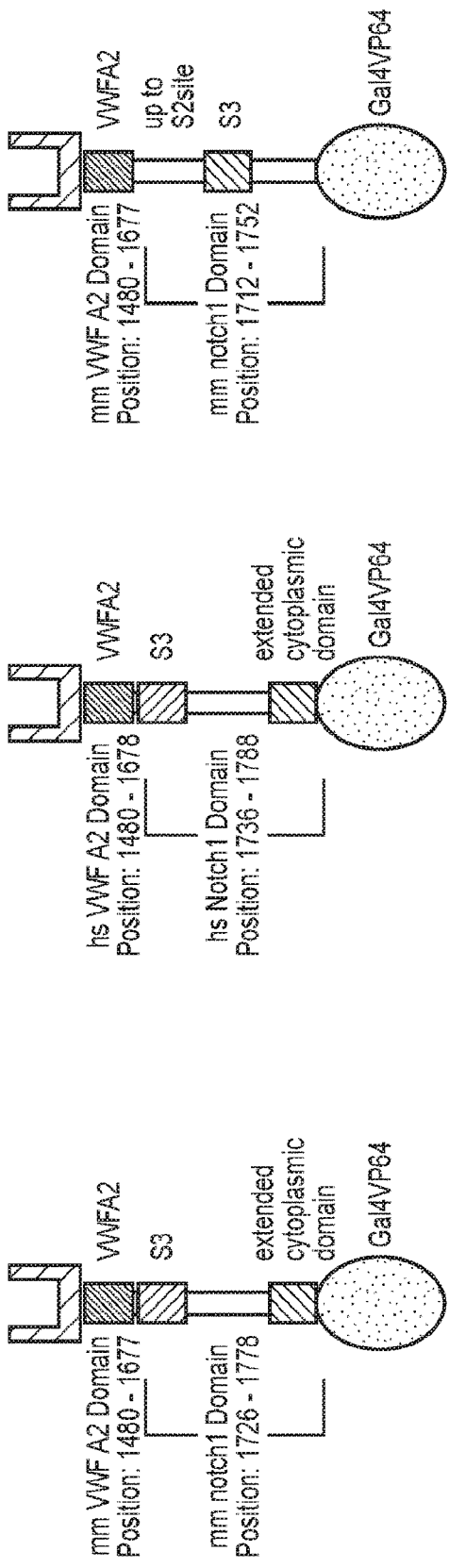
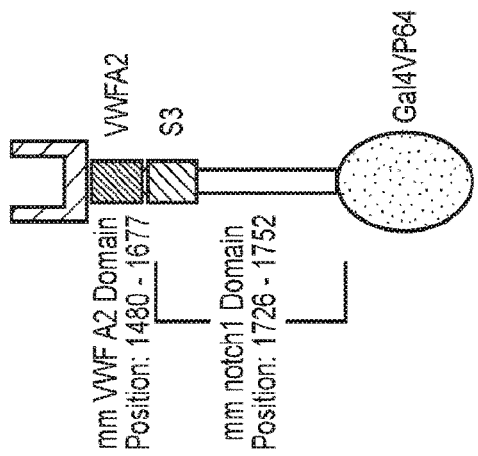
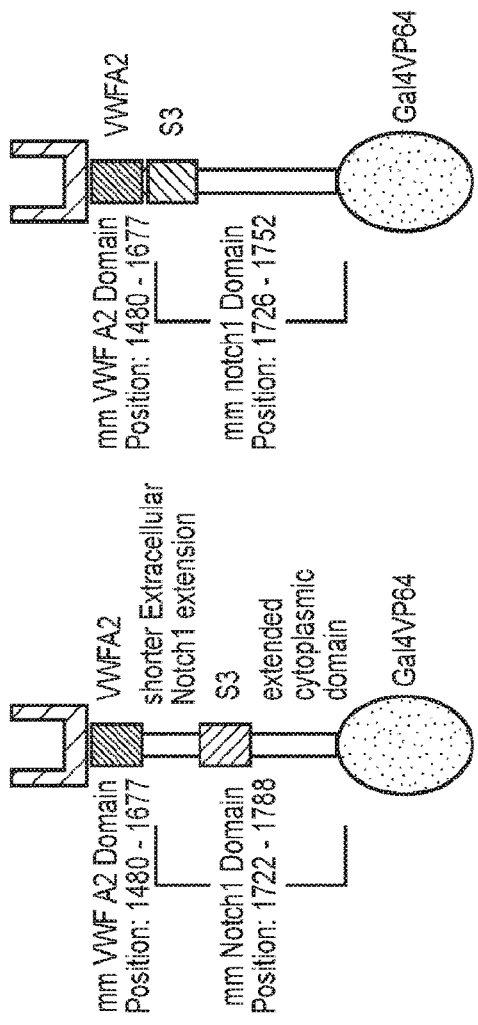
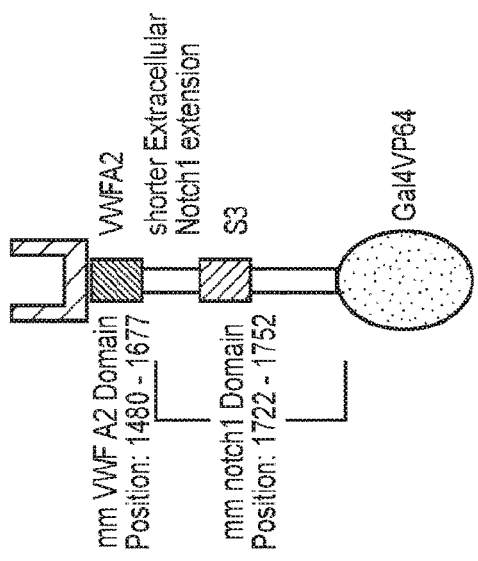

FORCE SENSOR CLEAVAGE DOMAIN CONTAINING CHIMERIC POLYPEPTIDES AND METHODS OF USE THEREOF

CROSS-REFERENCE TO RELATED APPLICATIONS

This application is a § 371 national phase of International Application No. PCT/US2018/061307, filed on Nov. 15, 2018, which claims the benefit of U.S. Provisional Patent Application Ser. No. 62/587,296 filed Nov. 16, 2017 and 62/588,079 filed Nov. 17, 2017; the disclosures of which applications are herein incorporated by reference.

STATEMENT REGARDING FEDERALLY SPONSORED RESEARCH

This invention was made with government support under grant nos. P50 GM081879 and GM109183, awarded by the National Institutes of Health. The government has certain rights in the invention.

INCORPORATION BY REFERENCE OF SEQUENCE LISTING PROVIDED AS A TEXT FILE

A Sequence Listing is provided herewith as a text file, "UCSF-557WO_SeqList_ST25.txt" created on Nov. 15, 2018 and having a size of 5,748 KB. The contents of the text file are incorporated by reference herein in their entirety.

INTRODUCTION

Conventionally, control of cellular behaviors and activities has been achieved through the use of inducible expression constructs driving expression of a protein that, when expressed, alters cellular behavior and/or activity. In the research setting, inducible expression systems have greatly advanced our understanding of many areas of the life sciences, including cell biology, molecular biology, genetics, biochemistry and others. Well-studied inducible cell systems (e.g., chemically inducible, optically inducible, etc.) generally affect cell behaviors and activities globally and/or require a user-provided input to restrict a change in activity to particular cells of a population or control the system, e.g., toggling the system "on" or "off". Cellular engineering has recently provided the ability to attempt to reprogram cells to detect signals in their environments, e.g., as provided by neighboring cells, and autonomously transduce such signaling inputs into desired behavioral or activity outputs.

SUMMARY

Provided are chimeric polypeptides which modulate various cellular processes following cleavage of a force sensor cleavage domain, including non-Notch force sensor cleavage domains, induced upon binding of a specific binding member of the chimeric polypeptide with its binding partner. Methods of using force sensor cleavage domain-containing chimeric polypeptides to modulate cellular functions, including e.g., modulation (including induction or repression) of gene expression, are also provided. Nucleic acids encoding the subject chimeric polypeptides and associated expression cassettes and vectors as well as cells that contain such nucleic acids and/or expression cassettes and vectors are provided. Also provided, are methods of monitoring cell-cell signaling and method of treating a subject using the described components, as well as kits for practicing the subject methods.

BRIEF DESCRIPTION OF THE DRAWINGS

FIG. 1A-1C provide schematic depictions of Notch receptor polypeptides, and the domain boundaries thereof, in which the Notch ligand-binding domain has been replaced with a follicle stimulating hormone receptor (FSHR) domain and the Notch regulator region (NRR) has been substituted with various von Willebrand Factor (vWF) A2 domains.

FIG. 2A-2D demonstrate Notch target gene activation following signal transduction by vWF A2 domain containing variants of FSHR-Notch constructs, as schematized in FIG. 1A-1C.

FIG. 3A-3D describe and demonstrate the use of the Mosaic Analysis by Promoter Swap (MAPS) assay used to generate the results provide in FIG. 2A-2D.

FIG. 4A-4F provide schematic depictions of chimeric polypeptides containing vWF force sensor cleavage domains, Notch domains, anti-CD19 specific extracellular domains and transcriptional activator intracellular domains according to certain embodiments of the present disclosure.

DEFINITIONS

Figure 1C:
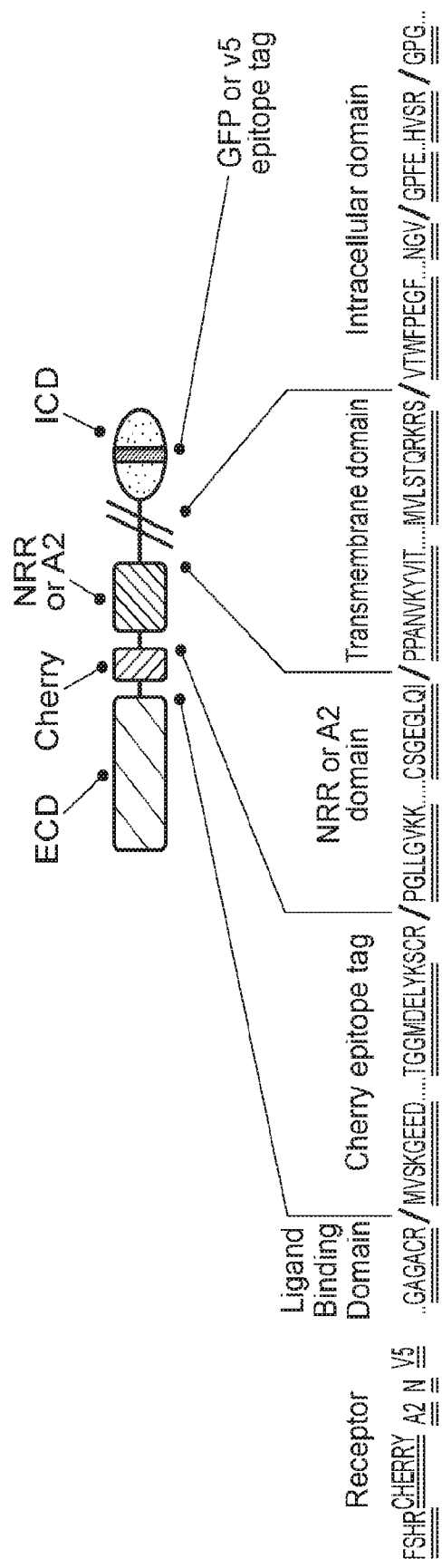

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases.

"Operably linked" refers to a juxtaposition wherein the components so described are in a relationship permitting them to function in their intended manner. For instance, a promoter is operably linked to a coding sequence if the promoter affects its transcription or expression. Operably linked nucleic acid sequences may but need not necessarily be adjacent. For example, in some instances a coding sequence operably linked to a promoter may be adjacent to the promoter. In some instances, a coding sequence operably linked to a promoter may be separated by one or more intervening sequences, including coding and non-coding sequences. Also, in some instances, more than two sequences may be operably linked including but not limited to e.g., where two or more coding sequences are operably linked to a single promoter.

A "vector" or "expression vector" is a replicon, such as plasmid, phage, virus, or cosmid, to which another DNA segment, i.e. an "insert", may be attached so as to bring about the replication of the attached segment in a cell.

"Heterologous," as used herein, means a nucleotide or polypeptide sequence that is not found in the native (e.g., naturally-occurring) nucleic acid or protein, respectively. Heterologous nucleic acids or polypeptide may be derived from a different species as the organism or cell within which the nucleic acid or polypeptide is present or is expressed. Accordingly, a heterologous nucleic acids or polypeptide is generally of unlike evolutionary origin as compared to the cell or organism in which it resides.

The terms "antibodies" and "immunoglobulin" include antibodies or immunoglobulins of any isotype, fragments of antibodies that retain specific binding to antigen, including, but not limited to, Fab, Fv, scFv, and Fd fragments, chimeric antibodies, humanized antibodies, single-chain antibodies (scAb), single domain antibodies (dAb), single domain heavy chain antibodies, a single domain light chain antibodies, nanobodies, bi-specific antibodies, multi-specific antibodies, and fusion proteins comprising an antigen-binding (also referred to herein as antigen binding) portion of an antibody and a non-antibody protein. The antibodies can be detectably labeled, e.g., with a radioisotope, an enzyme that generates a detectable product, a fluorescent protein, and the like. The antibodies can be further conjugated to other moieties, such as members of specific binding pairs, e.g., biotin (member of biotin-avidin specific binding pair), and the like. The antibodies can also be bound to a solid support, including, but not limited to, polystyrene plates or beads, and the like. Also encompassed by the term are Fab', Fv, F(ab')$_2$, and other antibody fragments that retain specific binding to antigen, and monoclonal antibodies. As used herein, a monoclonal antibody is an antibody produced by a group of identical cells, all of which were produced from a single cell by repetitive cellular replication. That is, the clone of cells only produces a single antibody species. While a monoclonal antibody can be produced using hybridoma production technology, other production methods known to those skilled in the art can also be used (e.g., antibodies derived from antibody phage display libraries). An antibody can be monovalent or bivalent. An antibody can be an Ig monomer, which is a "Y-shaped" molecule that consists of four polypeptide chains: two heavy chains and two light chains connected by disulfide bonds.

The term "humanized immunoglobulin" as used herein refers to an immunoglobulin comprising portions of immunoglobulins of different origin, wherein at least one portion comprises amino acid sequences of human origin. For example, the humanized antibody can comprise portions derived from an immunoglobulin of nonhuman origin with the requisite specificity, such as a mouse, and from immunoglobulin sequences of human origin (e.g., chimeric immunoglobulin), joined together chemically by conventional techniques (e.g., synthetic) or prepared as a contiguous polypeptide using genetic engineering techniques (e.g., DNA encoding the protein portions of the chimeric antibody can be expressed to produce a contiguous polypeptide chain). Another example of a humanized immunoglobulin is an immunoglobulin containing one or more immunoglobulin chains comprising a complementarity-determining region (CDR) derived from an antibody of nonhuman origin and a framework region derived from a light and/or heavy chain of human origin (e.g., CDR-grafted antibodies with or without framework changes). Chimeric or CDR-grafted single chain antibodies are also encompassed by the term humanized immunoglobulin. See, e.g., Cabilly et al., U.S. Pat. No. 4,816,567; Cabilly et al., European Patent No. 0,125,023 B1; Boss et al., U.S. Pat. No. 4,816,397; Boss et al., European Patent No. 0,120,694 B1; Neuberger, M. S. et al., WO 86/01533; Neuberger, M. S. et al., European Patent No. 0,194,276 B1; Winter, U.S. Pat. No. 5,225,539; Winter, European Patent No. 0,239,400 B1; Padlan, E. A. et al., European Patent Application No. 0,519,596 A1. See also, Ladner et al., U.S. Pat. No. 4,946,778; Huston, U.S. Pat. No. 5,476,786; and Bird, R. E. et al., Science, 242: 423-426 (1988)), regarding single chain antibodies.

The term "nanobody" (Nb), as used herein, refers to the smallest antigen binding fragment or single variable domain ($V_{HH}$) derived from naturally occurring heavy chain antibody and is known to the person skilled in the art. They are derived from heavy chain only antibodies, seen in camelids (Hamers-Casterman et al., 1993; Desmyter et al., 1996). In the family of "camelids" immunoglobulins devoid of light polypeptide chains are found. "Camelids" comprise old world camelids (*Camelus bactrianus* and *Camelus dromedarius*) and new world camelids (for example, *Llama paccos, Llama glama, Llama guanicoe* and *Llama vicugna*). A single variable domain heavy chain antibody is referred to herein as a nanobody or a $V_{HH}$ antibody.

"Antibody fragments" comprise a portion of an intact antibody, for example, the antigen binding or variable region of the intact antibody. Examples of antibody fragments include Fab, Fab', F(ab')$_2$, and Fv fragments; diabodies; linear antibodies (Zapata et al., Protein Eng. 8(10): 1057-1062 (1995)); domain antibodies (dAb; Holt et al. (2003) *Trends Biotechnol.* 21:484); single-chain antibody molecules; and multi-specific antibodies formed from antibody fragments. Papain digestion of antibodies produces two identical antigen-binding fragments, called "Fab'" fragments, each with a single antigen-binding site, and a residual "Fc" fragment, a designation reflecting the ability to crystallize readily. Pepsin treatment yields an F(ab')$_2$ fragment that has two antigen combining sites and is still capable of cross-linking antigen.

"Fv" is the minimum antibody fragment that contains a complete antigen-recognition and—binding site. This region consists of a dimer of one heavy- and one light-chain variable domain in tight, non-covalent association. It is in this configuration that the three CDRS of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The "Fab" fragment also contains the constant domain of the light chain and the first constant domain ($CH_1$) of the heavy chain. Fab fragments differ from Fab' fragments by the addition of a few residues at the carboxyl terminus of the heavy chain $CH_1$ domain including one or more cysteines from the antibody hinge region. Fab'-SH is the designation herein for Fab' in which the cysteine residue(s) of the constant domains bear a free thiol group. $F(ab')_2$ antibody fragments originally were produced as pairs of Fab' fragments which have hinge cysteines between them. Other chemical couplings of antibody fragments are also known.

The "light chains" of antibodies (immunoglobulins) from any vertebrate species can be assigned to one of two clearly distinct types, called kappa and lambda, based on the amino acid sequences of their constant domains. Depending on the amino acid sequence of the constant domain of their heavy chains, immunoglobulins can be assigned to different classes. There are five major classes of immunoglobulins: IgA, IgD, IgE, IgG, and IgM, and several of these classes can be further divided into subclasses (isotypes), e.g., IgG1, IgG2, IgG3, IgG4, IgA, and IgA2. The subclasses can be further divided into types, e.g., IgG2a and IgG2b.

"Single-chain Fv" or "sFv" or "scFv" antibody fragments comprise the $V_H$ and $V_L$ domains of antibody, wherein these domains are present in a single polypeptide chain. In some embodiments, the Fv polypeptide further comprises a polypeptide linker between the $V_H$ and $V_L$ domains, which enables the sFv to form the desired structure for antigen binding. For a review of sFv, see *Pluckthun in The Pharmacology of Monoclonal Antibodies*, vol. 113, Rosenburg and Moore eds., Springer-Verlag, New York, pp. 269-315 (1994).

The term "diabodies" refers to small antibody fragments with two antigen-binding sites, which fragments comprise a heavy-chain variable domain ($V_H$) connected to a light-chain variable domain ($V_L$) in the same polypeptide chain ($V_H$-$V_L$). By using a linker that is too short to allow pairing between the two domains on the same chain, the domains are forced to pair with the complementary domains of another chain and create two antigen-binding sites. Diabodies are described more fully in, for example, EP 404,097; WO 93/11161; and Hollinger et al. (1993) *Proc. Natl. Acad. Sci. USA* 90:6444-6448.

As used herein, the term "affinity" refers to the equilibrium constant for the reversible binding of two agents (e.g., an antibody and an antigen) and is expressed as a dissociation constant ($K_D$). Affinity can be at least 1-fold greater, at least 2-fold greater, at least 3-fold greater, at least 4-fold greater, at least 5-fold greater, at least 6-fold greater, at least 7-fold greater, at least 8-fold greater, at least 9-fold greater, at least 10-fold greater, at least 20-fold greater, at least 30-fold greater, at least 40-fold greater, at least 50-fold greater, at least 60-fold greater, at least 70-fold greater, at least 80-fold greater, at least 90-fold greater, at least 100-fold greater, or at least 1,000-fold greater, or more, than the affinity of an antibody for unrelated amino acid sequences. Affinity of an antibody to a target protein can be, for example, from about 100 nanomolar (nM) to about 0.1 nM, from about 100 nM to about 1 picomolar (pM), or from about 100 nM to about 1 femtomolar (fM) or more. As used herein, the term "avidity" refers to the resistance of a complex of two or more agents to dissociation after dilution. The terms "immunoreactive" and "preferentially binds" are used interchangeably herein with respect to antibodies and/or antigen-binding fragments.

The term "binding" refers to a direct association between two molecules, due to, for example, covalent, electrostatic, hydrophobic, and ionic and/or hydrogen-bond interactions, including interactions such as salt bridges and water bridges. In some cases, a specific binding member present in the extracellular domain of a chimeric polypeptide of the present disclosure binds specifically to its binding partner, such as an antigen or a peptide-major histocompatibility complex (peptide-MHC). "Specific binding" refers to binding with an affinity of at least about $10^{-7}$ M or greater, e.g., $5\times10^{-7}$ M, $10^{-8}$M, $5\times10^{-8}$M, and greater. "Non-specific binding" refers to binding with an affinity of less than about $10^{-7}$ M, e.g., binding with an affinity of $10^{-6}$ M, $10^{-5}$ M, $10^{-4}$ M, etc.

The terms "polypeptide," "peptide," and "protein", used interchangeably herein, refer to a polymeric form of amino acids of any length, which can include genetically coded and non-genetically coded amino acids, chemically or biochemically modified or derivatized amino acids, and polypeptides having modified peptide backbones. The term includes fusion proteins, including, but not limited to, fusion proteins with a heterologous amino acid sequence, fusions with heterologous and homologous leader sequences, with or without N-terminal methionine residues; immunologically tagged proteins; and the like.

An "isolated" polypeptide is one that has been identified and separated and/or recovered from a component of its natural environment. Contaminant components of its natural environment are materials that would interfere with diagnostic or therapeutic uses for the polypeptide, and may include enzymes, hormones, and other proteinaceous or nonproteinaceous solutes. In some embodiments, the polypeptide will be purified (1) to greater than 90%, greater than 95%, or greater than 98%, by weight of antibody as determined by the Lowry method, for example, more than 99% by weight, (2) to a degree sufficient to obtain at least 15 residues of N-terminal or internal amino acid sequence by use of a spinning cup sequenator, or (3) to homogeneity by sodium dodecyl sulfate-polyacrylamide gel electrophoresis (SDS-PAGE) under reducing or nonreducing conditions using Coomassie blue or silver stain. Isolated polypeptide includes the polypeptide in situ within recombinant cells since at least one component of the polypeptide's natural environment will not be present. In some instances, isolated polypeptide will be prepared by at least one purification step.

The terms "chimeric antigen receptor" and "CAR", used interchangeably herein, refer to artificial multi-module molecules capable of triggering or inhibiting the activation of an immune cell which generally but not exclusively comprise an extracellular domain (e.g., a ligand/antigen binding domain), a transmembrane domain and one or more intracellular signaling domains. The term CAR is not limited specifically to CAR molecules but also includes CAR variants. CAR variants include split CARs wherein the extracellular portion (e.g., the ligand binding portion) and the intracellular portion (e.g., the intracellular signaling portion) of a CAR are present on two separate molecules. CAR variants also include ON-switch CARs which are conditionally activatable CARs, e.g., comprising a split CAR wherein conditional hetero-dimerization of the two portions of the split CAR is pharmacologically controlled (e.g., as described in PCT publication no. WO 2014/127261 A1 and US Patent Application No. 2015/0368342 A1, the disclosures of which are incorporated herein by reference in their entirety). CAR variants also include bispecific CARs, which include a secondary CAR binding domain that can either amplify or inhibit the activity of a primary CAR. CAR variants also include inhibitory chimeric antigen receptors (iCARs) which may, e.g., be used as a component of a bispecific CAR system, where binding of a secondary CAR binding domain results in inhibition of primary CAR activation. CAR molecules and derivatives thereof (i.e., CAR variants) are described, e.g., in PCT Application No. US2014/016527; Fedorov et al. Sci Transl Med (2013);

5(215):215ra172; Glienke et al. Front Pharmacol (2015) 6:21; Kakarla & Gottschalk 52 Cancer J (2014) 20(2):151-5; Riddell et al. Cancer J (2014) 20(2):141-4; Pegram et al. Cancer J (2014) 20(2):127-33; Cheadle et al. Immunol Rev (2014) 257(1):91-106; Barrett et al. Annu Rev Med (2014) 65:333-47; Sadelain et al. Cancer Discov (2013) 3(4):388-98; Cartellieri et al., J Biomed Biotechnol (2010) 956304; the disclosures of which are incorporated herein by reference in their entirety. Useful CARs also include the anti-CD19-4-1BB-CD3ζ CAR expressed by lentivirus loaded CTL019 (Tisagenlecleucel-T) CAR-T cells as commercialized by Novartis (Basel, Switzerland).

As used herein, the terms "treatment," "treating," "treat" and the like, refer to obtaining a desired pharmacologic and/or physiologic effect. The effect can be prophylactic in terms of completely or partially preventing a disease or symptom thereof and/or can be therapeutic in terms of a partial or complete cure for a disease and/or adverse effect attributable to the disease. "Treatment," as used herein, covers any treatment of a disease in a mammal, particularly in a human, and includes: (a) preventing the disease from occurring in a subject which can be predisposed to the disease but has not yet been diagnosed as having it; (b) inhibiting the disease, i.e., arresting its development; and (c) relieving the disease, i.e., causing regression of the disease.

A "therapeutically effective amount" or "efficacious amount" refers to the amount of an agent, or combined amounts of two agents, that, when administered to a mammal or other subject for treating a disease, is sufficient to effect such treatment for the disease. The "therapeutically effective amount" will vary depending on the agent(s), the disease and its severity and the age, weight, etc., of the subject to be treated.

The terms "individual," "subject," "host," and "patient," used interchangeably herein, refer to a mammal, including, but not limited to, murines (e.g., rats, mice), non-human primates, humans, canines, felines, ungulates (e.g., equines, bovines, ovines, porcines, caprines), lagomorphs, etc. In some cases, the individual is a human. In some cases, the individual is a non-human primate. In some cases, the individual is a rodent, e.g., a rat or a mouse. In some cases, the individual is a lagomorph, e.g., a rabbit.

As used herein, the term "immune cells" generally includes white blood cells (leukocytes) which are derived from hematopoietic stem cells (HSC) produced in the bone marrow "Immune cells" includes, e.g., lymphocytes (T cells, B cells, natural killer (NK) cells) and myeloid-derived cells (neutrophil, eosinophil, basophil, monocyte, macrophage, dendritic cells).

"T cell" includes all types of immune cells expressing CD3 including T-helper cells ($CD4^+$ cells), cytotoxic T-cells ($CD8^+$ cells), T-regulatory cells (Treg) and gamma-delta T cells.

A "cytotoxic cell" includes $CD8^+$ T cells, natural-killer (NK) cells, and neutrophils, which cells are capable of mediating cytotoxicity responses.

The term "synthetic" as used herein generally refers to an artificially derived polypeptide or polypeptide encoding nucleic acid that is not naturally occurring. Such synthetic polypeptides and/or nucleic acids may be assembled de novo from basic subunits including, e.g., single amino acids, single nucleotides, etc., or may be derived from pre-existing polypeptides or polynucleotides, whether naturally or artificially derived, e.g., as through recombinant methods.

The term "recombinant", as used herein describes a nucleic acid molecule, e.g., a polynucleotide of genomic, cDNA, viral, semisynthetic, and/or synthetic origin, which, by virtue of its origin or manipulation, is not associated with all or a portion of the polynucleotide sequences with which it is associated in nature. The term recombinant as used with respect to a protein or polypeptide means a polypeptide produced by expression from a recombinant polynucleotide. The term recombinant as used with respect to a host cell or a virus means a host cell or virus into which a recombinant polynucleotide has been introduced. Recombinant is also used herein to refer to, with reference to material (e.g., a cell, a nucleic acid, a protein, or a vector) that the material has been modified by the introduction of a heterologous material (e.g., a cell, a nucleic acid, a protein, or a vector).

The term "force sensor cleavage domain", as used herein, refers to a polypeptide domain of a force sensitive protein that, upon the application of force, is cleavable, e.g., by a protease, including non-Notch force sensor cleavage domains. By "non-Notch force sensor cleavage domain", as used herein, is meant a cleavage domain of a force sensitive protein that is not, or is not derived from, a Notch protein. Such, non-Notch force sensor cleavage domains will not include a Notch negative regulatory region (NRR), Notch cleavage site(s) (e.g., S1, S2 or S3 sites) or any other portion of a Notch protein. However, in some instances, a non-Notch force sensor cleavage domain may be present in a polypeptide with other Notch-derived domains, such as domains of a Notch protein other than the Notch force sensitive cleavage domain Force sensor cleavage domains may be derived from force sensitive proteins from various species including but not limited to e.g., invertebrates (e.g., insects) and vertebrates (e.g., mammals such as mouse, rat, human and non-human primates), etc.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a cell" includes a plurality of such cells and reference to "the cell" includes reference to one or more cells and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

Provided are chimeric polypeptides which modulate various cellular processes following cleavage of a force sensor cleavage domain, including non-Notch force sensor cleavage domains, induced upon binding of a specific binding member of the chimeric polypeptide with its binding partner. Methods of using force sensor cleavage domain-containing chimeric polypeptides to modulate cellular functions, including e.g., modulation (including induction or repression) of gene expression, are also provided. Nucleic acids encoding the subject chimeric polypeptides and associated expression cassettes and vectors as well as cells that contain such nucleic acids and/or expression cassettes and vectors are provided. Also provided, are methods of monitoring cell-cell signaling and method of treating a subject using the described components, as well as kits for practicing the subject methods.

Chimeric Polypeptides

The present disclosure provides chimeric polypeptides comprising a non-Notch force sensor cleavage domain, e.g., a vWF cleavage domain, an amyloid-beta cleavage domain, a CD16 cleavage domain, a CD44 cleavage domain, a Delta cleavage domain, a cadherin cleavage domain, an ephrin-type receptor or ephrin ligand cleavage domain, a protocadherin (e.g., drosophila fat) cleavage domain, a filamin cleavage domain, an E cadherin cleavage domain, an interleukin-1 receptor type 2 (i.e., IL1R2) cleavage domain, a major prion protein (i.e., PrP) cleavage domain, a neuregulin cleavage domain, an adhesion-GPCR cleavage domain, and homologs and variants thereof.

The chimeric polypeptides of the instant disclosure may generally include: an extracellular domain comprising a first member of a binding pair; a force sensor cleavage domain (e.g., one of the force sensor cleavage domains identified herein) comprising a proteolytic cleavage site; a cleavable transmembrane domain; and an intracellular domain. Binding of a first member of the binding pair of a subject chimeric polypeptide to a second member of the binding pair may induce cleavage of the force sensor cleavage domain at the proteolytic cleavage site, thereby releasing the intracellular domain. For example, where the force sensor cleavage domain is a vWF cleavage domain, binding of a first member of the binding pair of a subject chimeric polypeptide to a second member of the binding pair may induce cleavage of the vWF cleavage domain at the proteolytic cleavage site, thereby releasing the intracellular domain. As such, the intracellular domain of a subject chimeric polypeptide will generally provide the effector function of the chimeric polypeptide which results from binding the binding partner to which the chimeric polypeptide is specific. Useful intracellular domains include Notch intracellular domains and non-Notch intracellular domains.

In some instances, the intracellular domain of a chimeric polypeptide may include a Notch intracellular signaling domain, wherein binding of the first member of the binding pair to a second member of the binding pair, e.g., present on a cell, induces cleavage of the force sensor cleavage domain at the proteolytic cleavage site, thereby releasing the intracellular domain Such a released intracellular domain comprising a Notch intracellular domain may induce Notch signaling, including e.g., canonical Notch signaling, non-canonical Notch signaling (e.g., RBPJ-independent NOTCH signaling), induced expression of one or more Notch target genes, etc.

Canonical Notch target genes that may be induced by a released intracellular domain of Notch which associates with the CSL (CBF1/Su(H)/Lag-1) transcription factor complex, resulting in subsequent activation of the canonical Notch target genes: Myc, p21, HES-family members, HEY-family members (e.g., HEY1), etc. Non-canonical Notch signaling that may be induced by a released intracellular domain of Notch include activation through R-Ras, interaction with IKKa in the NF-κB pathway, interaction with LEF1, associated downstream expression, and the like. Induced Notch target genes may be vertebrate or invertebrate genes, mammalian or non-mammalian genes, including e.g., human genes, non-human primate genes, rodent genes (e.g., mouse genes, rat genes, etc.), porcine genes, bovine genes, canine genes, insect genes (e.g., drosophila genes, etc.), and the like.

Non limiting examples of Notch target genes include drosophila cut (ct), drosophila wingless (wg), drosophila Hairy/E(spl)-related with YRPW motif (Hey), vertebrate HEY1, vertebrate HEY2, vertebrate HES1, apoptosis genes (e.g., CDKN1A, CFLAR (CASH), IL2RA and NFKB1), cell cycle regulators (e.g., CCND1, CDKN1A and IL2RA), cell proliferation genes (e.g., CDKN1A, ERBB2, FOSL1 and IL2RA), genes regulating cell differentiation (e.g., DTX1 and PPARG), neurogenesis genes (e.g., HES1 and HEY1), genes that regulate transcription (e.g., DTX1, FOS, FOSL1, HES1, HEY1, NFKB1, NFKB2, NR4A2, PPARG and STATE), CD44, CHUK, IFNG, IL17B, KRT1, LOR, MAP2K7, PDPK1, PTCRA, and the like.

Notch intracellular domains may be derived from any convenient and appropriate Notch polypeptide, including e.g., the Notch receptor polypeptides described herein. Non-limiting examples of Notch receptor polypeptides from which a useful Notch intracellular signaling domain may be derived include drosophila notch, C. elegans LIN-12, mouse Notch (e.g., mouse Notch1, mouse Notch2, mouse Notch3 or mouse Notch4), rat Notch (e.g., rat Notch1, rat Notch2 or rat Notch3), human Notch (e.g., human Notch1, human Notch2, human Notch3 or human Notch4), etc.

In some cases, a Notch intracellular domain may comprise an amino acid sequence having at least 50%, at least 55%, at least 60%, at least 65%, at least 70%, at least 75%, at least 80%, at least 85%, at least 90%, at least 95%, at least 98%, at least 99%, or 100%, amino acid sequence identity to one or more exemplary Notch proteins, including e.g., those described herein, including but not limited to e.g., those of the amino acid sequences of the Notch receptors of SEQ ID NOs:1-68.

In some instances, the Notch intracellular domain of a chimeric polypeptide of the present disclosure includes all or a portion of a drosophila notch NICD, a *C. elegans* LIN-12 NICD, a mouse Notch NICD (e.g., mouse Notch1 NICD, mouse Notch2 NICD, mouse Notch3 NICD or mouse Notch4 NICD), a rat Notch NICD (e.g., rat Notch1 NICD, rat Notch2 NICD or rat Notch3 NICD), a human Notch (e.g., human Notch1 NICD, human Notch2 NICD, human Notch3 NICD or human Notch4 NICD), etc.

In some instances, the intracellular domain of a chimeric polypeptide may not be a Notch intracellular domain and may not include a functional Notch intracellular signaling domain or any portion of a Notch intracellular signaling domain that contributes to wild-type canonical or non-canonical Notch downstream signaling. An intracellular domain that is not a Notch intracellular signaling domain may not share any significant sequence homology with a Notch intracellular signaling domain, i.e., the intracellular signaling domain may not be a homolog of a Notch intracellular signaling domain, including e.g., not homologous with any one or more of the Notch polypeptides described herein.

Intracellular domains that are not Notch intracellular signaling domains will generally not induce expression of Notch target genes. For example, a intracellular domain that is not a Notch intracellular signaling domain or does not include a Notch intracellular signaling domain, when released from a chimeric polypeptide, will not induce expression of Notch target genes, including canonical and non-canonical Notch target genes, through normal Notch signaling mechanisms, e.g., binding and associating with transcription factors and co-activators (e.g., CSL (i.e., CBF1, Suppressor of Hairless, Lag-1), mastermind (i.e., MAM), etc., to activate genes downstream of the Notch signaling pathway. Non-Notch intracellular domains may be derived from a variety of different natural and synthetic polypeptides and provide a variety of effector functions, as described in more detail below.

The chimeric polypeptides of the present disclosure will generally include a force sensor cleavage domain that is not derived from a Notch polypeptide (i.e., a non-Notch force sensor cleavage domain) Such non-Notch force sensor cleavage domains will vary and may be derived from a force sensitive protein or homolog or variant thereof and will generally include at least one proteolytic cleavage site of the force sensitive protein.

Force sensor cleavage domains that may find use in the instant chimeric polypeptides include vWF cleavage domains. Useful vWF cleavage domains will vary and may be derived from a vWF protein or homolog thereof and will generally include at least one proteolytic cleavage site of the vWF protein. Useful vWF proteolytic cleavage sites include ADAM family type protease cleavage sites, including e.g., ADAM-13 type protease cleavage sites. In some instances, a vWF polypeptide included in a chimeric polypeptide of the present disclosure may include a vWF A2 domain or a variant thereof. For example, in some instances, a vWF cleavage domain may include a mammalian vWF A2 domain, including but not limited to e.g., a human vWF A2 domain, a non-human primate vWF A2 domain, a rodent vWF A2 domain (e.g., a mouse vWF A2 domain, a rat vWF A2 domain, etc.) and the like. In some instances, a vWF cleavage domain may include a non-mammalian vWF A2 domain, including but not limited to e.g., an avian vWF A2 domain, a reptile vWF A2 domain, an amphibian vWF A2 domain, a fish vWF A2 domain, etc. Useful vWF A2 domains may include those vWF A2 domains that are naturally occurring or non-natural variants thereof, including e.g., domains having less than 100% sequence identity with a naturally occurring vWF A2 domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring vWF A2 domain (including e g, mammalian and/or non-mammalian vWF A2 domains).

Useful human vWF cleavage domains may include e g, amino acids 1480-1678 of the human vWF protein of UniProtKB ID P04275 or NCBI RefSeq ID NP_000543.2: PGLLGVSTLGPKRNSMVLDVAFVLEGSDKIGEAD-FNRSKEFMEEVIQRMDVGQDSIHVTVLQYS YMVTV-EYPFSEAQSKGDILQRVREIRYQGGNRTNTGLALR-YLSDHSFLVSQGDREQAPNLVYM VTGNPASDEIK-RLPGDIQVVPIGVGPNANVQELERIGWPNAPILIQD-FETLPREAPDLVLQRCCSG EGLQI (SEQ ID NO:69), or a polypeptide having less than 100% sequence identity with the provided sequence, including e.g., at least 99% sequence identity, at least 98%, at least 97%, at least 96%, at least 95%, at least 90%, at least 85%, at least 80%, at least 75%, at least 70%, at least 65% or at least 60% sequence identity with the provided sequence.

In some instances, a useful vWF cleavage domain may include the following amino acid sequence: PGLLGVKKLGPKRNSMVLDVAFVLEGSDKIGEAD-FNRSKEFMEEVIQRMDVGQDSIHVTVLQY SYMVT-VEYPFSEAQSKGDILQRVREIRYQGGNRTNTGLALR-YLSDHSFLVSQGDREQAPNLVY MVTGNPASDEIK-RLPGDIQVVPIGVGPNANVQELERIGWPNAPILIQD-FETLPREAPDLVLQRCCS GEGLQI (SEQ ID NO:70), or a polypeptide having less than 100% sequence identity with the provided sequence, including e.g., at least 99% sequence identity, at least 98%, at least 97%, at least 96%, at least 95%, at least 90%, at least 85%, at least 80%, at least 75%, at least 70%, at least 65% or at least 60% sequence identity with the provided sequence.

Useful mouse vWF cleavage domains may include e g, amino acids 1480-1678 of the mouse vWF protein of UniProtKB ID Q8CIZ8: PGIAGISSPGPKRKSMV-LDVVFVLEGSDEVGEANFNKSKEFVEEVIQRMDVSP-DATRISVLQYSY TVTMEYAFNGAQSKEEVLRHVREI-RYQGGNRTNTGQALQYLSEHSFSPSQGDRVEA-PNLVYMV TGNPASDEIKRLPGDIQVVPIGVGPHANM-QELERISRPIAPIFIRDFETLPREAPDLVLQTCCSKEG LQLP (SEQ ID NO:71), or a polypeptide having less than 100% sequence identity with the provided sequence, including e.g., at least 99% sequence identity, at least 98%, at least 97%, at least 96%, at least 95%, at least 90%, at least 85%, at least 80%, at least 75%, at least 70%, at least 65% or at least 60% sequence identity with the provided sequence.

Useful mouse vWF cleavage domains may include e g, amino acids 183-381 of GenBank ID AAA82929.1: PGIAGTLSPGPKRKSMVLDVVFVLEGSDEVGEANF-NKSKEFVEEVIQRMDVSPDATRISVLQYS YTVT-MEYAFNGAQSKEEVLRHVREIRYQGGNRTNTGQ- ALQYLSEHSFSPSQGDRVEAPNLVYM VTGNPAS-
DEIKRLPGDIQVVPIGVGPHANMQELERISRPIAPI-
FIRDFETLPREAPDLVLQTCCSKE GLQLP (SEQ ID NO:72), or a polypeptide having less than 100% sequence identity with the provided sequence, including e.g., at least 99% sequence identity, at least 98%, at least 97%, at least 96%, at least 95%, at least 90%, at least 85%, at least 80%, at least 75%, at least 70%, at least 65% or at least 60% sequence identity with the provided sequence.

Useful vWF cleavage domains will vary in length, including e.g., where the overall length of the vWF cleavage domain is 1000 amino acids or less, including e.g., 900 amino acids or less, 800 amino acids or less, 700 amino acids or less, 600 amino acids or less, 500 amino acids or less, 400 amino acids or less, 300 amino acids or less or 200 amino acids or less. In some instances, the subject vWF cleavage domain may range from less than 150 to more than 1000 amino acid in length, including but not limited to e.g., from 150 to 1000, from 150 to 900, from 150 to 800, from 150 to 700, from 150 to 600, from 150 to 500, from 150 to 400, from 150 to 350, from 150 to 300, from 150 to 275, from 150 to 250, from 150 to 225, from 150 to 200, or the like.

In some instances, a vWF cleavage domain may include sequence of a vWF protein in the N- and/or C-terminal direction adjacent to a vWF A2 domain, including up to 100 amino acids or more in the N- and/or C-terminal direction adjacent to the A2 domain, including but not limited to e.g., 100 amino acids or less, 90 amino acids or less, 80 amino acids or less, 70 amino acids or less, 60 amino acids or less, 50 amino acids or less, 40 amino acids or less, 30 amino acids or less, 20 amino acids or less, 10 amino acids or less, etc., in the N- and/or C-terminal direction adjacent to a vWF A2 domain.

In some instances, a subject vWF cleavage domain may include or exclude one or more vWF protein domains or a portion thereof, including e.g., one or more vWF protein domains near or adjacent to a vWF A2 domain, including but not limited to e.g., all or a portion of a VWFA 1 domain (as defined for e.g., by amino acids 1277-1453 of UniProtKB/RefSeq P04275/NP_000543.2 (SEQ ID NO:73) representing the binding site for platelet glycoprotein Ib), all or a portion of a VWFA 3 domain (as defined, e.g., by amino acids 1691-1871 of UniProtKB/RefSeq P04275/NP_000543.2 (SEQ ID NO:73) representing the main binding site for collagens type I and III), and the like. Additional vWF protein domains that may be included or excluded from a subject vWF cleavage domain include e.g., a VWFD 1 domain, a TIL 1 domain, a VWFD 2 domain, a TIL 2 domain, a TIL 3 domain, a VWFD 3 domain, a TIL 4 domain, a VWFD 4 domain, a VWFC 1 domain, a VWFC 2 domain, a VWFC 3 domain and a CTCK domain (for representative amino acid sequences of such domains see amino acid sequences 34-240, 295-348, 387-598, 652-707, 776-827, 866-1074, 1146-1196, 1949-2153, 2255-2328, 2429-2495, 2580-2645 and 2724-2812, respectively, of UniProtKB/RefSeq P04275/NP_000543.2 (SEQ ID NO:73). As will be readily understood, corresponding domains in other vWF homologs may be readily identified from sequence database sources, by primary sequence alignment or through structural studies.

Subject vWF cleavage domains may be derived from or include a portion of a sequence from a wide variety of vWF protein sequences. Useful vWF proteins from which a vWF cleavage domain may be derived or from which sequence may be used in developing a vWF cleavage domain include but are not limited to homologs of human and/or mouse vWF protein, including e.g., rat vWF protein (Entrz Gene 116669; Chr4 q42; UniProt Q62935; RefSeq_NM_053889, SEQ ID NOs:74-75); chimpanzee vWF protein (Entrz Gene 451773; Chr12; RefSeq XP_001160508, SEQ ID NOs:76); cattle vWF protein (Entrz Gene 280958; Chr5 q35; UniProt P80012; RefSeq NM_001205308, SEQ ID NOs:77-78); dog vWF protein (Entrz Gene 399544; Chr27; UniProt Q28295; RefSeq NM_001002932, SEQ ID NOs:79-80); chicken vWF protein (Entrz Gene 419031; Chr1; RefSeq NP_001305393; RefSeq NM_001318464, SEQ ID NOs:81-82); zebrafish vWF protein (Entrz Gene 570643; Chr18; RefSeq NP_001268918; RefSeq NM_001281989, SEQ ID NOs:83-84); western clawed frog vWF protein (Entrz Gene 100492314; Chr3; RefSeq NP_001243217; RefSeq NM_001256288, SEQ ID NOs:85-86); rhesus macaque vWF protein (Entrz Gene 722019; Chr11; RefSeq NP_001230015; RefSeq NM_001243086, SEQ ID NOs:87-88); and the like.

Useful vWF proteins from which a vWF cleavage domain may be derived or from which sequence may be used in developing a vWF cleavage domain include but are not limited to e.g., UniProt/UniParc entries: A0A061HVW2 (*Cricetulus griseus* (Chinese hamster) (*Cricetulus barabensis griseus*), SEQ ID NO:89); A0A0611269 (*Cricetulus griseus* (Chinese hamster) (*Cricetulus barabensis griseus*), SEQ ID NO:90); A0A096N8H2 (*Papio anubis* (Olive baboon), SEQ ID NO:91); A0A0D9REG6 (*Chlorocebus sabaeus* (Green monkey) (*Cercopithecus sabaeus*), SEQ ID NO:92); A0A1D5QD20 (*Macaca mulatta* (Rhesus macaque), SEQ ID NO:93); A0A1D5R0L5 (*Macaca mulatta* (Rhesus macaque), SEQ ID NO:94); E9QPU1 (*Mus musculus* (Mouse), SEQ ID NO:95); F5XVB6 (*Macaca mulatta* (Rhesus macaque), SEQ ID NO:96); F5XVC0 (Pongo abelii (Sumatran orangutan) (Pongo pygmaeus abelii), SEQ ID NO:97); F6W3M9 (Callithrix jacchus (White-tufted-ear marmoset), SEQ ID NO:98); F6WF14 (*Macaca mulatta* (Rhesus macaque), SEQ ID NO:99); G1PTM8 (Myotis lucifugus (Little brown bat), SEQ ID NO:100); G1QTE2 (*Nomascus leucogenys* (Northern white-cheeked gibbon) (*Hylobates leucogenys*), SEQ ID NO:101); G3GUL3 (*Cricetulus griseus* (Chinese hamster) (*Cricetulus barabensis griseus*), SEQ ID NO:102); H2Q597 (*Pan troglodytes* (Chimpanzee), SEQ ID NO:103); L5M9A9 (Myotis davidii (David's myotis), SEQ ID NO:104); L8E853 (*Homo sapiens* (Human), SEQ ID NO:105); P04275 (*Homo sapiens* (Human), SEQ ID NO:106); Q2I0J7 (*Mus musculus* (Mouse), SEQ ID NO:107); Q2I0J8 (*Mus musculus* (Mouse), SEQ ID NO:108); Q8CIZ8 (*Mus musculus* (Mouse), SEQ ID NO:109); S7PV68 (Myotis brandtii (Brandt's bat), SEQ ID NO:110); U3B406 (Callithrix jacchus (White-tufted-ear marmoset), SEQ ID NO:111); U3E5B5 (Callithrix jacchus (White-tufted-ear marmoset), SEQ ID NO:112); UPI00006C2065 (synthetic construct; *Homo sapiens* (Human), SEQ ID NO:113); UPI0000F22350 (*Mus musculus* (Mouse), SEQ ID NO:114); UPI0001D37492 (Callithrix jacchus (White-tufted-ear marmoset), SEQ ID NO:115); UPI0002745399 (*Pan paniscus* (Pygmy chimpanzee) (Bonobo), SEQ ID NO:116); UPI00027FBC2A (Saimiri boliviensis boliviensis (Bolivian squirrel monkey), SEQ ID NO:117); UPI00038C4FC7 (Microtus ochrogaster (Prairie vole), SEQ ID NO:118); UPI0003AB8AB8 (*Macaca fascicularis* (Crab-eating macaque) (Cynomolgus monkey), SEQ ID NO:119); UPI0003ABBB93 (*Macaca fascicularis* (Crab-eating macaque) (Cynomolgus monkey), SEQ ID NO:120); UPI0003BB8000 (Myotis brandtii (Brandt's bat), SEQ ID NO:121); UPI0003D7602E (*Mus musculus* (Mouse), SEQ ID NO:122); UPI00045DA85A (*Chlorocebus sabaeus* (Green monkey) (*Cercopithecus sabaeus*), SEQ ID NO:123); UPI00045E4833 (*Chlorocebus sabaeus* (Green monkey) (*Cercopithecus sabaeus*), SEQ ID NO:124); UPI00046BB32A (*Eptesicus fuscus* (Big brown bat) (*Vespertilio fuscus*), SEQ ID NO:125); UPI000533025E (*Rhinopithecus roxellana* (Golden snub-nosed monkey) (*Pygathrix roxellana*), SEQ ID NO:126); UPI0005F4961F (*Cercocebus atys* (Sooty mangabey) (*Cercocebus torquatus atys*), SEQ ID NO:127); UPI0005F4C367 (*Mandrillus leucophaeus* (Drill) (*Papio leucophaeus*), SEQ ID NO:128); UPI00062ABFC1 (*Nomascus leucogenys* (Northern white-cheeked gibbon) (*Hylobates leucogenys*), SEQ ID NO:129); UPI00077DB9FD (*Peromyscus maniculatus bairdii* (prairie deer mouse), SEQ ID NO:130); UPI0007A6CF81 (*Miniopterus natalensis* (Natal long-fingered bat) (*Miniopterus schreibersii natalensis*), SEQ ID NO:131); UPI0007DA4C47 (*Cricetulus griseus* (Chinese hamster) (*Cricetulus barabensis griseus*), SEQ ID NO:132); UPI0007DA4F39 (*Cricetulus griseus* (Chinese hamster) (*Cricetulus barabensis griseus*), SEQ ID NO:133); UPI0007DBB9D1 (*Pan troglodytes* (Chimpanzee), SEQ ID NO:134); UPI00080A4F5A (*Cebus capucinus imitator*, SEQ ID NO:135); UPI00083C799B (*Rhinopithecus bieti* (Black snub-nosed monkey) (*Pygathrix bieti*), SEQ ID NO:136); UPI00083EA408 (*Papio anubis* (Olive baboon), SEQ ID NO:137); UPI000A30FD00 (*Mus pahari* (Gairdner's shrew-mouse) (*Coelomys pahari*), SEQ ID NO:138); UP1000A3231F0 (*Mesocricetus auratus* (Golden hamster), SEQ ID NO:139); UPI000B4FFA00 (*Aotus nancymaae* (Ma's night monkey), SEQ ID NO:140); UPI000B4FFE39 (*Aotus nancymaae* (Ma's night monkey), SEQ ID NO:141); UPI000B7B2374 (*Papio anubis* (Olive baboon), SEQ ID NO:142); UPI000B7B8141 (*Papio anubis* (Olive baboon), SEQ ID NO:143); and the like.

In some instances, a useful vWF cleavage domain may include a variant domain, including natural and synthetic variants. For example, in some instances, a variant vWF cleavage domain may include one or more of the following variations: I1628T, R1597W, E1638K, M1528V and/or I1638K, numbered relative to human vWF protein (e.g., UniProtKB ID P04275 or NCBI RefSeq ID NP_000543.2; SEQ ID NO:73). In some instances, a variant vWF cleavage domain may include one or more of the following variations: F1514C, L1540P, R1597G, R1597Q, R1597W, V1607D, G1609R, 51613P, I1628T, E1638K, P1648S and/or V1665E, numbered relative to human vWF protein (e.g., UniProtKB ID P04275 or NCBI RefSeq ID NP_000543.2; SEQ ID NO:73). In some instances, a vWF cleavage domain variant may be recombinantly produced.

Force sensor cleavage domains that may find use in the instant chimeric polypeptides include amyloid-beta cleavage domains. Useful amyloid-beta cleavage domains will vary and may be derived from an amyloid-beta protein (e.g., amyloid-beta A4 protein, amyloid precursor protein (APP), etc.) or homolog thereof and will generally include at least one proteolytic cleavage site of the amyloid-beta protein. In some instances, an amyloid-beta polypeptide included in a chimeric polypeptide of the present disclosure may be a mammalian amyloid-beta cleavage domain or a variant thereof, including but not limited to e.g., human, non-human primate, rodent (e.g., mouse, rat, etc.), and the like amyloid-beta cleavage domains and homologs and variants thereof. Useful amyloid-beta cleavage domains may include those amyloid-beta cleavage domains that are naturally occurring or non-natural variants thereof, including e.g., domains having less than 100% sequence identity with a naturally occurring amyloid-beta cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring amyloid-beta cleavage domain (including e g, mammalian and/or non-mammalian amyloid-beta cleavage domains.

Useful amyloid-beta cleavage domains may include e.g., those derived from accession number RefSeq NP_001129603.1 (SEQ ID NO:240) or a homolog or variant thereof, including e.g.: MVSKGEEDNSDVWWGGA-DTDYADGSEDKVVEVAEEEEVAEVEEEEADDDED-DEDGDEVEEE AEEPYEEATERTTSIATTTTTTES-VEEVVRVPTTAASTPDAVDKYLETPGDENEHAHFQ-KAKER LEAKHRERMSQVMREWEEAERQAKNLPK-ADKKAVIQHFQEKVESLEQEAANERQQLVETHM ARVEAMLNDRRRLALENYITALQAVPPRPRHVFN-MLKKYVRAEQKDRQHTLKHFEHVRMVDP KKAAQ-IRSQVMTHLRVIYERMNQSLSLLYNVPAVAEEIQDE-VDELLQKEQNYSDDVLANMISEP RISYGNDALMP-SLTETKTTVELLPVNGEFSLDDLQPWHSFGADSV-PANTENEVEPVDARPAADR GLTTRPGSGLTNIKTEEI-SEVNLDAEFRHDSGYEVHHQKLVFFAEDVGSNKGR (SEQ ID NO:241), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject amyloid-beta cleavage domains may be derived from or include a portion of a sequence from a wide variety of amyloid-beta protein sequences. Useful amyloid-beta proteins from which a amyloid-beta cleavage domain may be derived or from which sequence may be used in developing a amyloid-beta cleavage domain include but are not limited to the following proteins and/or homologs thereof, including e.g., *Homo sapiens* APP, Uniprot ID P05067 (SEQ ID NO:276); *Mus musculus* APP, Uniprot ID P12023 (SEQ ID NO:277); *Rattus norvegicus* APP, Uniprot ID P08592 (SEQ ID NO:278); *Sus scrofa* APP, Uniprot ID P79307 (SEQ ID NO:279); *Pan troglodytes* APP, Uniprot ID Q51580 (SEQ ID NO:280); *Cavia porcellus* APP, Uniprot ID Q60495 (SEQ ID NO:281); Saimiri sciureus APP, Uniprot ID Q95241 (SEQ ID NO:282); *Macaca fascicularis* APP, Uniprot ID P53601 (SEQ ID NO:283); *Takifugu rubripes* APP, Uniprot ID 093279 (SEQ ID NO:284); *Xenopus laevis* APP, Uniprot ID Q6NRR1 (SEQ ID NO:285); *Tetraodon fluviatilis* APP, Uniprot ID 073683 (SEQ ID NO:286); etc.

Force sensor cleavage domains that may find use in the instant chimeric polypeptides include CD16 cleavage domains. Useful CD16 cleavage domains will vary and may be derived from a CD16 protein (e.g., low affinity immunoglobulin gamma Fc region receptor III protein) or homolog thereof and will generally include at least one proteolytic cleavage site of the CD16 protein. In some instances, a CD16 polypeptide included in a chimeric polypeptide of the present disclosure may be a mammalian CD16 cleavage domain or a variant thereof, including but not limited to e.g., human, non-human primate, rodent (e.g., mouse, rat, etc.), and the like CD16 cleavage domains and homologs and variants thereof. Useful CD16 cleavage domains may include those CD16 cleavage domains that are naturally occurring or non-natural variants thereof, including e.g., domains having less than 100% sequence identity with a naturally occurring CD16 cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring CD16 cleavage domain (including e.g., mammalian CD16 cleavage domains).

Useful CD16 cleavage domains may include e.g., those derived from accession number RefSeq NP_001121065.1 (SEQ ID NO:242) or a homolog or variant thereof, including e.g.: GMRTEDLPKAVVFLEPQWYRVLEKDSVTLKCQ-GAYSPEDNSTQWFHNESLISSQASSYFIDAAT VDDS-GEYRCQTNLSTLSDPVQLEVHIGWLLLQAPRWVF-KEEDPIHLRCHSWKNTALHKVTYLQ NGKGRKYFH-HNSDFYIPKATLKDSGSYFCRGLFGSKNVSSETVNI-TITQGLAVSTISSFFPPGYQV R (SEQ ID NO:243), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject CD16 cleavage domains may be derived from or include a portion of a sequence from a wide variety of CD16 protein sequences. Useful CD16 proteins from which a CD16 cleavage domain may be derived or from which sequence may be used in developing a CD16 cleavage domain include but are not limited to the following proteins and/or homologs thereof, including e.g., *Homo sapiens* FCGR3A/CD16, Uniprot ID P08637 (SEQ ID NO:287); *Homo sapiens* FCGR3A/CD16, Uniprot ID O75015 (SEQ ID NO:288); *Macaca mulatta* FCGR3A/CD16, Uniprot ID A3RFZ7 (SEQ ID NO:289); *Rattus norvegicus* FCGR3A/CD16, Uniprot ID A0A0B4J2J1 (SEQ ID NO:290); *Rattus norvegicus* FCGR3A/CD16, Uniprot ID Q6XPU4 (SEQ ID NO:291); *Felis catus* FCGR3A/CD16, Uniprot ID Q9N2I5 (SEQ ID NO:292); *Bos taurus* FCGR3A/CD16, Uniprot ID Q2KI63 (SEQ ID NO:293); *Macaca mulatta* FCGR3A/CD16, Uniprot ID H9BMP7 (SEQ ID NO:294); *Ovis aries* FCGR3A/CD16, Uniprot ID W5PK31 (SEQ ID NO:295); *Homo sapiens* FCGR3A/CD16, Uniprot ID A0A1W2PQB1 (SEQ ID NO:296); *Macaca mulatta* FCGR3A/CD16, Uniprot ID H9BMP8 (SEQ ID NO:297); *Dipodomys ordii* FCGR3A/CD16, Uniprot ID A0A1S3GAX9 (SEQ ID NO:298); *Dipodomys ordii* FCGR3A/CD16, Uniprot ID A0A1S3GD93 (SEQ ID NO:299); etc.

Force sensor cleavage domains that may find use in the instant chimeric polypeptides include CD44 cleavage domains. Useful CD44 cleavage domains will vary and may be derived from a CD44 protein (e.g., CD44 antigen isoform a precursor) or homolog thereof and will generally include at least one proteolytic cleavage site of the CD44 protein. In some instances, a CD44 polypeptide included in a chimeric polypeptide of the present disclosure may be a mammalian CD44 cleavage domain or a variant thereof, including but not limited to e.g., human, non-human primate, rodent (e.g., mouse, rat, etc.), and the like CD44 cleavage domains and homologs and variants thereof. Useful CD44 cleavage domains may include those CD44 cleavage domains that are naturally occurring or non-natural variants thereof, including e.g., domains having less than 100% sequence identity with a naturally occurring CD44 cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring CD44 cleavage domain (including e g, mammalian and/or non-mammalian CD44 cleavage domains).

Useful CD44 cleavage domains may include e.g., those derived from accession number RefSeq NP_033981.2 (SEQ ID NO:244) or a homolog or variant thereof, including e.g.: PRHSKSHAAAQKQNNWIWSWFGNSQSTTQTQEPTT-SATTALMTTPETPPKRQEAQNWFSWLFQ PSESK-SHLHTTTKMPGTESNTNPTGWEPNEENEDETDKYP-SFSGSGIDDDEDFISSTIASTPRVSA RTEDNQDWTQW-KPNHSNPEVLLQTTTRMADIDRISTSAHGENWTPEP-QPPFNNHEYQDEEETP HATSTTPNSTAEAAATQQET-WFQNGWQGKNPPTPSEDSHVTEGTTASAHNNHP-SQRITTQSQED VSWTDFFDPISHPMGQGHQTESKD-TDSSHSTTLQPTAAPNTHLVEDLNRTGPLSVTTPQS-HSQNF STLHGEPEEDENHPTTSILPSSTKSGAKDARR-GGSLPTDTTTSVEGYTFQYPDTMENGTLFPVTP AKT-EVFGETEVTLATDSNVNVDGSLPGDRDSSKDSRGSS-RTVTHGSELAGHSSANQDSGVTTTS GPMRRPQIPER (SEQ ID NO:245), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject CD44 cleavage domains may be derived from or include a portion of a sequence from a wide variety of CD44 protein sequences. Useful CD44 proteins from which a CD44 cleavage domain may be derived or from which sequence may be used in developing a CD44 cleavage domain include but are not limited to the following proteins and/or homologs thereof, including e.g., *Homo sapiens* CD44, Uniprot ID P16070 (SEQ ID NO:300); *Mus musculus* CD44, Uniprot ID P15379 (SEQ ID NO:301); *Rattus norvegicus* CD44, Uniprot ID P26051 (SEQ ID NO:302); *Mesocricetus auratus* CD44, Uniprot ID Q60522 (SEQ ID NO:303); *Cricetulus griseus* CD44, Uniprot ID P20944 (SEQ ID NO:304); *Bos taurus* CD44, Uniprot ID Q29423 (SEQ ID NO:305); *Equus caballus* CD44, Uniprot ID Q05078 (SEQ ID NO:306); *Papio hamadryas* CD44, Uniprot ID P14745 (SEQ ID NO:307); *Canis lupus familiaris* CD44, Uniprot ID Q28284 (SEQ ID NO:308); *Sus scrofa* CD44, Uniprot ID F1SGT4 (SEQ ID NO:309); *Oryctolagus cuniculus* CD44, Uniprot ID G1SDW8 (SEQ ID NO:310); *Canis lupus familiaris* CD44, Uniprot ID F1PTZ7 (SEQ ID NO:311); *Gorilla gorilla gorilla* CD44, Uniprot ID G3QEY3 (SEQ ID NO:312); *Felis catus* CD44, Uniprot ID M3W4X0 (SEQ ID NO:313); *Danio rerio* CD44, Uniprot ID E7F6T0 (SEQ ID NO:314); etc.

Force sensor cleavage domains that may find use in the instant chimeric polypeptides include Delta cleavage domains. Useful Delta cleavage domains will vary and may be derived from a Delta protein (e.g., *Drosophila* neurogenic locus protein delta) or homolog thereof and will generally include at least one proteolytic cleavage site of the Delta protein. In some instances, a Delta polypeptide included in a chimeric polypeptide of the present disclosure may be a mammalian Delta cleavage domain or a variant thereof, including but not limited to e.g., human, non-human primate, rodent (e.g., mouse, rat, etc.), and the like Delta cleavage domains and homologs and variants thereof. Useful Delta cleavage domains may include those Delta cleavage domains that are naturally occurring or non-natural variants thereof, including e.g., domains having less than 100% sequence identity with a naturally occurring Delta cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring Delta cleavage domain (including e g, mammalian and/or non-mammalian Delta cleavage domains).

Useful Delta cleavage domains may include e.g., those derived from accession number GenBank CAA29617.1 (SEQ ID NO:246) or a homolog or variant thereof, including e.g.: PRDEESYDSVTFDAHQYGATTQARADG-LANAQVR (SEQ ID NO:247), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject Delta cleavage domains may be derived from or include a portion of a sequence from a wide variety of Delta protein sequences. Useful Delta proteins from which a Delta cleavage domain may be derived or from which sequence may be used in developing a Delta cleavage domain include but are not limited to the following proteins and/or homologs thereof, including e.g., *Mus musculus* Delta-like protein, Uniprot ID Q61483 (SEQ ID NO:315); *Homo sapiens* Delta-like protein, Uniprot ID O00548 (SEQ ID NO:316); *Homo sapiens* Delta-like protein, Uniprot ID Q9NR61 (SEQ ID NO:317); *Mus musculus* Delta-like protein, Uniprot ID Q9JI71 (SEQ ID NO:318); *Rattus norvegicus* Delta-like protein, Uniprot ID P97677 (SEQ ID NO:319); *Danio rerio* Delta-like protein, Uniprot ID Q8UWJ4 (SEQ ID NO:320); *Danio rerio* Delta-like protein, Uniprot ID Q6DI48 (SEQ ID NO:321); *Rattus norvegicus* Delta-like protein, Uniprot ID D3ZHH1 (SEQ ID NO:322); *Danio rerio* Delta-like protein, Uniprot ID Q9IAT6 (SEQ ID NO:323); *Bos taurus* Delta-like protein, Uniprot ID E1BN18 (SEQ ID NO:324); *Pan troglodytes* Delta-like protein, Uniprot ID H2QU26 (SEQ ID NO:325); *Macaca mulatta* Delta-like protein, Uniprot ID F7HB47 (SEQ ID NO:326); *Rattus norvegicus* Delta-like protein, Uniprot ID G3V7W6 (SEQ ID NO:327); *Gallus gallus* Delta-like protein, Uniprot ID F1NRS3 (SEQ ID NO:328); *Pelodiscus sinensis* Delta-like protein, Uniprot ID K7FSA9 (SEQ ID NO:329); *Gorilla gorilla gorilla* Delta-like protein, Uniprot ID G3QRX5 (SEQ ID NO:330); *Mus musculus* Delta-like protein, Uniprot ID O88516 (SEQ ID NO:331); *Homo sapiens* Delta-like protein, Uniprot ID Q9NYJ7 (SEQ ID NO:332); *Rattus norvegicus* Delta-like protein, Uniprot ID O88671 (SEQ ID NO:333); *Danio rerio* Delta-like protein, Uniprot ID O57409 (SEQ ID NO:334); *Ciona intestinalis* Delta-like protein, Uniprot ID Q4H3Q6 (SEQ ID NO:335); *Drosophila melanogaster* Delta, Uniprot ID P10041 (SEQ ID NO:336); *Drosophila melanogaster* Delta-like protein, Uniprot ID A4V346 (SEQ ID NO:337); etc.

Force sensor cleavage domains that may find use in the instant chimeric polypeptides include cadherin cleavage domains. Useful cadherin cleavage domains will vary and may be derived from a cadherin protein (e.g., cadherin-1 preproprotein) or homolog thereof and will generally include at least one proteolytic cleavage site of the cadherin protein. In some instances, a cadherin polypeptide included in a chimeric polypeptide of the present disclosure may be a mammalian cadherin cleavage domain or a variant thereof, including but not limited to e.g., human, non-human primate, rodent (e.g., mouse, rat, etc.), and the like cadherin cleavage domains and homologs and variants thereof. Useful cadherin cleavage domains may include those cadherin cleavage domains that are naturally occurring or non-natural variants thereof, including e.g., domains having less than 100% sequence identity with a naturally occurring cadherin cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring cadherin cleavage domain (including e g, mammalian and/or non-mammalian cadherin cleavage domains).

Useful cadherin cleavage domains may include e.g., those derived from accession number RefSeq NP_033994.1 (SEQ ID N0:248) or a homolog or variant thereof, including e.g.: AEMDREDAEHVKNSTYVALIIATDDGSPIATGTGTL-LLVLLDVNDNAPIPEPRNMQFCQRNPQP HIITILDP-DLPPNTSPFTAELTHGASVNWTIEYNDAAQESLIL-QPRKDLEIGEYKIHLKLADNQNK DQVTTLDVHVC-DCEGTVNNCMKAGIVAAGLQVR (SEQ ID NO:249), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject cadherin cleavage domains may be derived from or include a portion of a sequence from a wide variety of cadherin protein sequences. Useful cadherin proteins from which a cadherin cleavage domain may be derived or from which sequence may be used in developing a cadherin cleavage domain include but are not limited to the following proteins and/or homologs thereof, including e.g., *Homo sapiens* Cadherin-1, Uniprot ID P12830 (SEQ ID NO:338); *Mus musculus* Cadherin-1, Uniprot ID P09803 (SEQ ID NO:339); *Homo sapiens* Cadherin-23, Uniprot ID Q9H251 (SEQ ID NO:340); *Drosophila melanogaster* DE-cadherin, Uniprot ID Q24298 (SEQ ID NO:341); *Mus musculus* Cadherin-2, Uniprot ID P15116 (SEQ ID NO:342); *Danio rerio* Cadherin-2, Uniprot ID Q90275 (SEQ ID NO:343); *Homo sapiens* Cadherin-13, Uniprot ID P55290 (SEQ ID NO:344); *Homo sapiens* Cadherin-2, Uniprot ID P19022 (SEQ ID NO:345); *Gallus gallus* Cadherin-2, Uniprot ID P10288 (SEQ ID NO:346); *Mus musculus* Cadherin-23, Uniprot ID Q99PF4 (SEQ ID NO:347); *Rattus norvegicus* Cadherin-2, Uniprot ID Q9Z1Y3 (SEQ ID NO:348); *Drosophila melanogaster* Neural-cadherin, Uniprot ID O15943 (SEQ ID NO:349); *Homo sapiens* Cadherin-3, Uniprot ID P22223 (SEQ ID NO:350); *Homo sapiens* Cadherin-5, Uniprot ID P33151 (SEQ ID NO:351); *Mus musculus* Cadherin-5, Uniprot ID P55284 (SEQ ID NO:352); *Rattus norvegicus* Cadherin-1, Uniprot ID Q9ROT4 (SEQ ID NO:353); *Mus musculus* Cadherin-13, Uniprot ID Q9WTR5 (SEQ ID NO:354); *Canis lupus familiaris* Cadherin-1, Uniprot ID F1PAA9 (SEQ ID NO:355); *Gallus gallus* Cadherin-13, Uniprot ID P33150 (SEQ ID NO:356); etc.

Force sensor cleavage domains that may find use in the instant chimeric polypeptides include ephrin-type receptor and ephrin ligand cleavage domains. Useful ephrin-type receptor and ephrin ligand cleavage domains will vary and may be derived from an ephrin-type receptor and ephrin ligand proteins (e.g., ephrin type-B receptor 2, ephrin-B2 precursor, ephrin-A2 precursor, etc.) or homolog thereof and will generally include at least one proteolytic cleavage site of the protein. In some instances, an ephrin-type receptor or ephrin ligand polypeptide included in a chimeric polypeptide of the present disclosure may be a mammalian ephrin-type receptor or ephrin ligand cleavage domain or a variant thereof, including but not limited to e.g., human, non-human primate, rodent (e.g., mouse, rat, etc.), and the like ephrin-type receptor or ephrin ligand cleavage domains and homologs and variants thereof. Useful ephrin-type receptor and ephrin ligand cleavage domains may include those ephrin-type receptor and ephrin ligand cleavage domains that are naturally occurring or non-natural variants thereof, including e.g., domains having less than 100% sequence identity with a naturally occurring ephrin-type receptor or ephrin ligand cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring ephrin-type receptor or ephrin ligand cleavage domain (including e g, mammalian and/or non-mammalian ephrin-type receptor and ephrin ligand cleavage domains).

Useful ephrin-type receptor and ephrin ligand cleavage domains may include e.g., those derived from accession numbers RefSeq NP_001277682.1 (SEQ ID NO:250), RefSeq NP_034241.2 (SEQ ID NO:251), RefSeq NP_031935.3 (SEQ ID NO:252) or a homolog or variant thereof, including e.g.: NGAIFQETLSGAESTSLVAARGS-CIANAEEVDVPIKLYCNGDGEWLVPIGRCMCKAGFE-AVENG TVCRGCPSGTFKANQGDEACTHCPINSRTT-SEGATNCVCRNGYYRADLDPLDMPCTTIPSAPQA VISSVNETSLMLEWTPPRDSGGREDLVYNIICKSCGS-GRGACTRCGDNVQYAPRQLGLTEPRIYI SDLLAHT-QYTFEIQAVNGVTDQSPFSPQFASVNITTNQAAPSAV-SIMHQVSRTVDSITLSWSQPD QPNGVILDYELQYYE-KQELSEYNATAIKSPTNTVTVQGLKAGAIYVFQV-RARTVAGYGRYSGK MYFQTMTEAEYQTSIKEKLPR (SEQ ID NO:253), APSAVSIMHQVSRTVDSITL-SWSQPDQPNGVILDYELQYYEKQELSEYNATAIKSP-TNTVTVQGL KAGAIYVFQVRARTVAGYGRYSGK-MYFQTMTEAEYQTSIKEKLPR (SEQ ID NO:254), MAMARSRRDSVWKYCWGLLMVLCRTAISRSIVL-EPIYWNSSNSKFLPGQGLVLYPQIGDKLDII CPKVD-SKTVGQYEYYKVYMVDKDQADRCTIKKENTPLLN-CARPDQDVKFTIKFQEFSPNLWGL EFQKNKDYYIIST-SNGSLEGLDNQEGGVCQTRAMKILMKVGQDASSA-GSARNHGPTRRPELEA GTNGRSSTTSPFVKPNP-GSSTDGNSAGHSGNNLLGSEVALFAR (SEQ ID NO:255), VYVRPTNETLYEAPEPIFTSNSSCSGLGGCH-LFLTTVPVLWSLLGSR (SEQ ID NO:256), or GQDAS-SAGSARNHGPTRRPELEAGTNGRSSTTSPFVKPNPG-SSTDGNSAGHSGNNLLGSEVALF AR (SEQ ID NO:257) or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject ephrin-type receptor and ephrin ligand cleavage domains may be derived from or include a portion of a sequence from a wide variety of ephrin-type receptor or ephrin ligand protein sequences. Useful ephrin-type receptor and ephrin ligand proteins from which an ephrin-type receptor or ephrin ligand cleavage domain may be derived or from which sequence may be used in developing an ephrin-type receptor or ephrin ligand cleavage domain include but are not limited to the following proteins and/or homologs thereof, including e.g., *Mus musculus* Ephrin type-B receptor 2, Uniprot ID P54763 (SEQ ID NO:357); *Homo sapiens* Ephrin type-A receptor 2, Uniprot ID P29317 (SEQ ID NO:358); *Mus musculus* Ephrin type-A receptor 2, Uniprot ID Q03145 (SEQ ID NO:359); *Mus musculus* Ephrin type-A receptor 4, Uniprot ID Q03137 (SEQ ID NO:360); *Homo sapiens* Ephrin type-B receptor 1, Uniprot ID P54762 (SEQ ID NO:361); *Homo sapiens* Ephrin type-A receptor 4, Uniprot ID P54764 (SEQ ID NO:362); *Homo sapiens* Ephrin type-B receptor 2, Uniprot ID P29323 (SEQ ID NO:363); *Mus musculus* Ephrin type-B receptor 1, Uniprot ID Q8CBF3 (SEQ ID NO:364); *Homo sapiens* Ephrin type-A receptor 3, Uniprot ID P29320 (SEQ ID NO:365); *Homo sapiens* Ephrin-A1, Uniprot ID P20827 (SEQ ID NO:366); *Homo sapiens* Ephrin type-A receptor 1, Uniprot ID P21709 (SEQ ID NO:367); *Mus musculus* Ephrin type-A receptor 7, Uniprot ID Q61772 (SEQ ID NO:368); *Homo sapiens* Ephrin type-B receptor 4, Uniprot ID P54760 (SEQ ID NO:369); *Mus musculus* Ephrin-A5, Uniprot ID O08543 (SEQ ID NO:370); *Homo sapiens* Ephrin type-B receptor 3, Uniprot ID P54753 (SEQ ID NO:371); *Caenorhabditis elegans* Ephrin receptor 1, Uniprot ID O61460 (SEQ ID NO:372); *Mus musculus* Ephrin type-A receptor 8, Uniprot ID O09127 (SEQ ID NO:373); *Mus musculus* Ephrin type-B receptor 3, Uniprot ID P54754 (SEQ ID NO:374); *Homo sapiens* Ephrin-B2, Uniprot ID P52799 (SEQ ID NO:375); *Homo sapiens* Ephrin type-A receptor 7, Uniprot ID Q15375 (SEQ ID NO:376); *Mus musculus* Ephrin-A1, Uniprot ID P52793 (SEQ ID NO:377); *Homo sapiens* Ephrin-B1, Uniprot ID P98172 (SEQ ID NO:378); *Homo sapiens* Ephrin-A5, Uniprot ID P52803 (SEQ ID NO:379); *Mus musculus* Ephrin type-A receptor 3, Uniprot ID P29319 (SEQ ID NO:380); *Mus musculus* Ephrin-B2, Uniprot ID P52800 (SEQ ID NO:381); *Homo sapiens* Ephrin type-A receptor 5, Uniprot ID P54756 (SEQ ID NO:382); *Homo sapiens* Ephrin type-B receptor 6, Uniprot ID O15197 (SEQ ID NO:383); *Mus musculus* Ephrin type-A receptor 5, Uniprot ID Q60629 (SEQ ID NO:384); *Rattus norvegicus* Ephrin type-A receptor 7, Uniprot ID P54759 (SEQ ID NO:385); *Rattus norvegicus* Ephrin type-B receptor 1, Uniprot ID P09759 (SEQ ID NO:386); *Gallus gallus* Ephrin type-A receptor 4, Uniprot ID Q07496 (SEQ ID NO:387); *Rattus norvegicus* Ephrin type-A receptor 5, Uniprot ID P54757 (SEQ ID NO:388); *Homo sapiens* Ephrin type-A receptor 8, Uniprot ID P29322 (SEQ ID NO:389); *Mus musculus* Ephrin-B1, Uniprot ID P52795 (SEQ ID NO:390); *Mus musculus* Ephrin type-A receptor 1, Uniprot ID Q60750 (SEQ ID NO:391); *Homo sapiens* Ephrin-B3, Uniprot ID Q15768 (SEQ ID NO:392); *Rattus norvegicus* Ephrin-A1, Uniprot ID P97553 (SEQ ID NO:393); *Drosophila melanogaster* Ephrin, Uniprot ID Q9V4E1 (SEQ ID NO:394); etc.

Force sensor cleavage domains that may find use in the instant chimeric polypeptides include protocadherin cleavage domains. Useful protocadherin cleavage domains will vary and may be derived from a protocadherin protein (e.g., *Drosophila* fat) or homolog thereof and will generally include at least one proteolytic cleavage site of the protocadherin protein. In some instances, a protocadherin polypeptide included in a chimeric polypeptide of the present disclosure may be a mammalian protocadherin cleavage domain or a variant thereof, including but not limited to e.g., human, non-human primate, rodent (e.g., mouse, rat, etc.), and the like protocadherin cleavage domains and homologs and variants thereof. Useful protocadherin cleavage domains may include those protocadherin cleavage domains that are naturally occurring or non-natural variants thereof, including e.g., domains having less than 100% sequence identity with a naturally occurring protocadherin cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring protocadherin cleavage domain (including e.g., mammalian and/or non-mammalian protocadherin cleavage domains).

Useful protocadherin cleavage domains may include e.g., those derived from accession number RefSeq NP_477497.1 (SEQ ID NO:258) or a homolog or variant thereof, including e.g.: DNQQMRERRAVSNFSTASQIYEAPKMLSML-FRTYKDQGQILYAATNQMFTSLSLREGRLVYYS KQHLTINMTVQETSTLNDGKWHNVSLFSESRSLR-LIVDGRQVGDELDIAGVHDFLDPYLTILNV GGEAF-VGCLANVTVNNELQPLNGSGSIFPEVRYHGKIESGC-RGDIGQDAAQVADPLSIGFTLVIV FFVILVVAIL-GSYVIYRFR (SEQ ID NO:259), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject protocadherin cleavage domains may be derived from or include a portion of a sequence from a wide variety of protocadherin protein sequences. Useful protocadherin proteins from which a protocadherin cleavage domain may be derived or from which sequence may be used in developing a protocadherin cleavage domain include but are not limited to the following proteins and/or homologs thereof, including e.g., *Drosophila melanogaster* Fat, Uniprot ID P33450 (SEQ ID NO:395); *Drosophila melanogaster* Fat-like cadherin-related tumor suppressor homolog, Uniprot ID Q9VW71 (SEQ ID NO:396); *Mus musculus* Protocadherin Fat 4, Uniprot ID Q2PZL6 (SEQ ID NO:397); *Homo sapiens* Protocadherin Fat 1, Uniprot ID Q14517 (SEQ ID NO:398); *Mus musculus* Protocadherin Fat 3, Uniprot ID Q8BNA6 (SEQ ID NO:399); *Mus musculus* Fat 1 cadherin, Uniprot ID Q9QXA3 (SEQ ID NO:400); *Rattus norvegicus* Protocadherin, Uniprot ID Q9WU10 (SEQ ID NO:401); *Mus musculus* Protocadherin Fat 3, Uniprot ID E9QK16 (SEQ ID NO:402); *Homo sapiens* Protocadherin Fat 1, Uniprot ID A0A087WVP1 (SEQ ID NO:403); etc.

Force sensor cleavage domains that may find use in the instant chimeric polypeptides include filamin cleavage domains. Useful filamin cleavage domains will vary and may be derived from a filamin protein (e.g., filamin-A isoform 2) or homolog thereof and will generally include at least one proteolytic cleavage site of the filamin protein. In some instances, a filamin polypeptide included in a chimeric polypeptide of the present disclosure may be a mammalian filamin cleavage domain or a variant thereof, including but not limited to e.g., human, non-human primate, rodent (e.g., mouse, rat, etc.), and the like filamin cleavage domains and homologs and variants thereof. Useful filamin cleavage domains may include those filamin cleavage domains that are naturally occurring or non-natural variants thereof, including e.g., domains having less than 100% sequence identity with a naturally occurring filamin cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring filamin cleavage domain (including e g, mammalian and/or non-mammalian filamin cleavage domains).

Useful filamin cleavage domains may include e.g., those derived from accession number RefSeq NP_001104026.1 (SEQ ID NO:260) or a homolog or variant thereof, including e.g.: MACKMQIFVKTLTGKTITLEVEPSDTIENVKAK-IQDKEGIPPDQQRLIFAGKQLEDGRTLSDYNIQ KES-TLHLVLRLRGGELGGSGGSGEGRVKESITRRRRAPS-VANVGSHSDLSLKIPEISIQDMTAQV TSPSGKTHEA-EIVEGENHTYSIRFVPAEMGTHTVSVKYKGQHVP-GSPFQFTVGPLGEGGAHKVR AGGPGLERAEAGV-PAEFSIWTREAGAGGLAIAVEGPSKAEISFEDRKDG-SSGVAYVVQEPGDYE VSVKFNEEHIPDSPFVVPVAS-PSSGGSGGTMQIFVKTLTGKTITLEVEPSDTIENVKA-KIQDKEGIP PDQQRLIFAGKQLEDGRTLSDYNIQKE-STLHLVLRLRGGKCLER (SEQ ID NO:261) or MACKMQIFVKTLTGKTITLEVEPSDTIENVKAKIQD-KEGIPPDQQRLIFAGKQLEDGRTLSDYNIQ KES-TLHLVLRLRGGELGGSGGPTFRSSLFLWVRPGGSG-GSGPLGEGGAHKVRAGGPGLERAEA GVPAEFS-IWTREAGAGGLAIAVEGPSKAEISFEDRKDGSCGVAY-VVQEPGDYEVSVKFNEEHIP DSPFVVPVASPSSGG-SGGTMQIFVKTLTGKTITLEVEPSDTIENVKAKIQD-KEGIPPDQQRLIFAG KQLEDGRTLSDYNIQKESTL-HLVLRLRGGKCLER (SEQ ID NO:262), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject filamin cleavage domains may be derived from or include a portion of a sequence from a wide variety of filamin protein sequences. Useful filamin proteins from which a filamin cleavage domain may be derived or from which sequence may be used in developing a filamin cleavage domain include but are not limited to the following proteins and/or homologs thereof, including e.g., *Homo sapiens* Filamin-A, Uniprot ID P21333 (SEQ ID NO:404); *Homo sapiens* Filamin-B, Uniprot ID O75369 (SEQ ID NO:405); *Mus musculus* Filamin-A, Uniprot ID Q8BTM8 (SEQ ID NO:406); *Homo sapiens* Filamin-C, Uniprot ID Q14315 (SEQ ID NO:407); *Drosophila melanogaster* Filamin-A, Uniprot ID Q9VEN1 (SEQ ID NO:408); *Rattus norvegicus* Filamin A, Uniprot ID C0JPT7 (SEQ ID NO:409); *Mus musculus* Filamin-B, Uniprot ID Q80X90 (SEQ ID NO:410); *Mus musculus* Filamin-C, Uniprot ID Q8VHX6 (SEQ ID NO:411); *Mus musculus* Filamin, alpha, Uniprot ID B7FAU9 (SEQ ID NO:412); *Rattus norvegicus* Filamin-C, Uniprot ID D3ZHAO (SEQ ID NO:413); *Macaca mulatta* Filamin A, Uniprot ID F7GCM2 (SEQ ID NO:414); *Canis lupus familiaris* Filamin A, Uniprot ID F1PWW0 (SEQ ID NO:415); *Felis catus* Filamin A, Uniprot ID M3WF12 (SEQ ID NO:416); *Ovis aries* Filamin A, Uniprot ID W5P5A0 (SEQ ID NO:417); *Equus caballus* Filamin A, Uniprot ID F7BH02 (SEQ ID NO:418); *Oryctolagus cuniculus* Filamin-B, Uniprot ID Q9MZD2 (SEQ ID NO:419); *Rattus norvegicus* Filamin B, Uniprot ID A0A0G2JXT8 (SEQ ID NO:420); *Taeniopygia guttata* Filamin B, Uniprot ID H0ZAR1 (SEQ ID NO:421); Callithrix jacchus Filamin B, Uniprot ID F6R465 (SEQ ID NO:422); *Danio rerio* Filamin C, gamma b, Uniprot ID F1QL44 (SEQ ID NO:423); etc.

Force sensor cleavage domains that may find use in the instant chimeric polypeptides include E cadherin cleavage domains. Useful E cadherin cleavage domains will vary and may be derived from an E cadherin protein or homolog thereof or recombinant variants thereof (e.g., EcadTS) and will generally include at least one proteolytic cleavage site of the E cadherin protein. In some instances, an E cadherin polypeptide included in a chimeric polypeptide of the present disclosure may be a mammalian E cadherin cleavage domain or a variant thereof, including but not limited to e.g., human, non-human primate, rodent (e.g., mouse, rat, etc.), and the like E cadherin cleavage domains and homologs and variants thereof. Useful E cadherin cleavage domains may include those E cadherin cleavage domains that are naturally occurring or non-natural variants thereof, including e.g., domains having less than 100% sequence identity with a naturally occurring E cadherin cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring E cadherin cleavage domain (including e.g., mammalian and/or non-mammalian E cadherin cleavage domains).

Useful E cadherin cleavage domains may include e.g., those derived from accession number GenBank AID22384.1 (SEQ ID NO:263) or a homolog or variant thereof, including e.g.: MVSKGEETTMGVIKPDMKIKLKMEGNVNG-HAFVIEGEGEGKPYDGTNTINLEVKEGAPLPFSY DIL-TTAFAYGNRAFTKYPDDIPNYFKQSFPEGYSWE-RTMTFEDKGIVKVKSDISMEEDSFIYEIHL KGENFP-PNGPVMQKKTTGWDASTERMYVRDGVLKGDV-KHKLLLEGGGHHRVDFKTIYRAKK AVKLPDYHFVD-HRIEILNHDKDYNKVTVYESAVARNSTDGMDE-LYKGPGGAGPGGAGPGGAG PGGAGPGGAGPG-GAGPGGAGPGGAMVSKGEELFTGVVPILVELDGDV-NGHKFSVSGEGEGDA TYGKLTLKLICTTGKLPV-PWPTLVTTLGYGLQCFARYPDHMKQHDFFKSAMP-EGYVQERTIFFK DDGNYKTRAEVKFEGDTLVNRI-ELKGIDFKEDGNILGHKLEYNYNSHNVYITAD-KQKNGIKANF KIRHNIEDGGVQLADHYQQNTP-IGDGPVLLPDNHYLSYQSKLSKDPNEKRDHM-VLLEFVTAAGI TLGMDELYK (SEQ ID NO:264), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Force sensor cleavage domains that may find use in the instant chimeric polypeptides include interleukin-1 receptor type 2 (i.e. IL1R2) cleavage domains. Useful IL1R2 cleavage domains will vary and may be derived from an IL1R2 protein (e.g., interleukin-1 receptor type 2 isoform 1 precursor) or homolog thereof and will generally include at least one proteolytic cleavage site of the IL1R2 protein. In some instances, an IL1R2 polypeptide included in a chimeric polypeptide of the present disclosure may be a mammalian IL1R2 cleavage domain or a variant thereof, including but not limited to e.g., human, non-human primate, rodent (e.g., mouse, rat, etc.), and the like IL1R2 cleavage domains and homologs and variants thereof. Useful IL1R2 cleavage domains may include those IL1R2 cleavage domains that are naturally occurring or non-natural variants thereof, including e.g., domains having less than 100% sequence identity with a naturally occurring IL1R2 cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring IL1R2 cleavage domain (including e.g., mammalian and/or non-mammalian IL1R2 cleavage domains).

Useful IL1R2 cleavage domains may include e.g., those derived from accession number RefSeq NP_004624.1 (SEQ ID NO:265) or a homolog or variant thereof, including e.g.: AARSCRFRGRHYKREFRLEGEPVALRCPQVPYWL-WASVSPRINLTWHKNDSARTVPGEEETRM WAQD-GALWLLPALQEDSGTYVCTTRNASYCDKMSIELR-VFENTDAFLPFISYPQILTLSTSGVLV CPDLSEFTRD-KTDVKIQWYKDSLLLDKDNEKFLSVRGTTHLL-VHDVALEDAGYYRCVLTFAHE GQQYNITRSIELRIK-KKKEETIPVIISPLKTISASLGSRLTIPCKVFLGTGTP-LTTMLWWTANDTHIE SAYPGGRVTEGPRQEYSEN-NENYIEVPLIFDPVTREDLHMDFKCVVHNTLSFQTL-RTTVKEASST FSGR (SEQ ID NO:266), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject IL1R2 cleavage domains may be derived from or include a portion of a sequence from a wide variety of IL1R2 protein sequences. Useful IL1R2 proteins from which an IL1R2 cleavage domain may be derived or from which sequence may be used in developing an IL1R2 cleavage domain include but are not limited to the following proteins and/or homologs thereof, including e.g., *Homo sapiens* IL1R2, Uniprot ID P27930 (SEQ ID NO:424); *Mus musculus* IL1R2, Uniprot ID P27931 (SEQ ID NO:425); *Chlorocebus aethiops* IL1R2, Uniprot ID Q29612 (SEQ ID NO:426); *Rattus norvegicus* IL1R2, Uniprot ID P43303 (SEQ ID NO:427); *Mus musculus* IL1R2, Uniprot ID Q4FK69 (SEQ ID NO:428); *Mus musculus* IL1R2, Uniprot ID Q8K084 (SEQ ID NO:429); etc.

Force sensor cleavage domains that may find use in the instant chimeric polypeptides include major prion protein (i.e. PrP) cleavage domains. Useful PrP cleavage domains will vary and may be derived from a PrP protein (e.g., major prion protein precursor) or homolog thereof and will generally include at least one proteolytic cleavage site of the PrP protein. In some instances, a PrP polypeptide included in a chimeric polypeptide of the present disclosure may be a mammalian PrP cleavage domain or a variant thereof, including but not limited to e.g., human, non-human primate, rodent (e.g., mouse, rat, etc.), and the like PrP cleavage domains and homologs and variants thereof. Useful PrP cleavage domains may include those PrP cleavage domains that are naturally occurring or non-natural variants thereof, including e.g., domains having less than 100% sequence identity with a naturally occurring PrP cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring PrP cleavage domain (including e g, mammalian and/or non-mammalian PrP cleavage domains).

Useful PrP cleavage domains may include e.g., those derived from accession number RefSeq NP_035300.1 (SEQ ID NO:267) or a homolog or variant thereof, including e.g.: KRPKPGGWNTGGSRYPGQGSPGGNRYPPQGGT-WGQPHGGGWGQPHGGSWGQPHGGSWGQP HGGG-WGQGGGTHNQWNKPSKPKTNLKHVAGAAAAGA-VVGGLGGYMLGSAMSRPMIHFGND WEDRYYRE-NMYRYPNQVYYRPVDQYSNQNNFVHDCVNITIKQH-TVTTTTKGENFTETDVKM MERVVEQMCVTQYQKE-SQAYYDGRRSSSTVLFSSPPVILLISFLIFLIVGR (SEQ ID NO:268), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject PrP cleavage domains may be derived from or include a portion of a sequence from a wide variety of PrP protein sequences. Useful PrP proteins from which a PrP cleavage domain may be derived or from which sequence may be used in developing a PrP cleavage domain include but are not limited to the following proteins and/or homologs thereof, including e.g., *Homo sapiens* PrP, Uniprot ID P04156 (SEQ ID NO:430); *Mus musculus* PrP, Uniprot ID P04925 (SEQ ID NO:431); *Mesocricetus auratus* PrP, Uniprot ID P04273 (SEQ ID NO:432); *Rattus norvegicus* PrP, Uniprot ID P13852 (SEQ ID NO:433); *Ovis aries* PrP, Uniprot ID P23907 (SEQ ID NO:434); *Bos taurus* PrP, Uniprot ID P10279 (SEQ ID NO:435); *Oryctolagus cuniculus* PrP, Uniprot ID Q95211 (SEQ ID NO:436); *Sus scrofa* PrP, Uniprot ID P49927 (SEQ ID NO:437); *Macaca mulatta* PrP, Uniprot ID P67997 (SEQ ID NO:438); *Pan troglodytes* PrP, Uniprot ID P61768 (SEQ ID NO:439); *Gorilla gorilla gorilla* PrP, Uniprot ID P40252 (SEQ ID NO:440); *Cricetulus griseus* PrP, Uniprot ID Q60506 (SEQ ID NO:441); *Capra hircus* PrP, Uniprot ID P52113 (SEQ ID NO:442); *Felis catus* PrP, Uniprot ID O18754 (SEQ ID NO:443); *Canis lupus familiaris* PrP, Uniprot ID O46501 (SEQ ID NO:444); *Xenopus tropicalis* PrP, Uniprot ID A2BDH3 (SEQ ID NO:445); *Taeniopygia guttata* PrP, Uniprot ID A2BDI7 (SEQ ID NO:446); *Gasterosteus aculeatus* PrP-like, Uniprot ID A2BDJ7 (SEQ ID NO:447); *Gasterosteus aculeatus* PrP, Uniprot ID A2BDK2 (SEQ ID NO:448); etc.

Force sensor cleavage domains that may find use in the instant chimeric polypeptides include neuregulin cleavage domains. Useful neuregulin cleavage domains will vary and may be derived from a neuregulin protein (e.g., pro-neuregulin-1, membrane-bound isoform isoform 111-3, neuregulin Nrg1 (type III), etc.) or homolog thereof and will generally include at least one proteolytic cleavage site of the neuregulin protein. In some instances, a neuregulin polypeptide included in a chimeric polypeptide of the present disclosure may be a mammalian neuregulin cleavage domain or a variant thereof, including but not limited to e.g., human, non-human primate, rodent (e.g., mouse, rat, etc.), and the like neuregulin cleavage domains and homologs and variants thereof. Useful neuregulin cleavage domains may include those neuregulin cleavage domains that are naturally occurring or non-natural variants thereof, including e.g., domains having less than 100% sequence identity with a naturally occurring neuregulin cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring neuregulin cleavage domain (including e g, mammalian and/or non-mammalian neuregulin cleavage domains).

Useful neuregulin cleavage domains may include e.g., those derived from accession number RefSeq NP_001309136.1 (SEQ ID NO:269) or a homolog or variant thereof, including e.g.: GDRCQNYVMASFYKHL-GIEFMEAEELYQKRVLTITGICIAR (SEQ ID NO:270), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject neuregulin cleavage domains may be derived from or include a portion of a sequence from a wide variety of neuregulin protein sequences. Useful neuregulin proteins from which a neuregulin cleavage domain may be derived or from which sequence may be used in developing a neuregulin cleavage domain include but are not limited to the following proteins and/or homologs thereof, including e.g., *Homo sapiens* Pro-neuregulin-1, Uniprot ID Q02297 (SEQ ID NO:449); *Mus musculus* Neuregulin 1, Uniprot ID Q6DR99 (SEQ ID NO:450); *Mus musculus* Neuregulin 1, Uniprot ID Q6DR98 (SEQ ID NO:451); *Mus musculus* Neuregulin 1, Uniprot ID A0A140LIK5 (SEQ ID NO:452); *Mus musculus* Neuregulin 1, Uniprot ID A0A140LJC1 (SEQ ID NO:453); *Rattus norvegicus* Pro-neuregulin-1, Uniprot ID P43322 (SEQ ID NO:454); *Canis lupus familiaris* Neuregulin 1, Uniprot ID F1Q0Y7 (SEQ ID NO:455); *Bos taurus* Neuregulin 1, Uniprot ID F1MPD0 (SEQ ID NO:456); *Pan troglodytes* Neuregulin 1, Uniprot ID H2QW02 (SEQ ID NO:457); *Ornithorhynchus anatinus* Neuregulin 1, Uniprot ID F7CIT4 (SEQ ID NO:458); *Equus caballus* Neuregulin 1, Uniprot ID F6RG52 (SEQ ID NO:459); *Cavia porcellus* Neuregulin 1, Uniprot ID H0VAV0 (SEQ ID NO:460); *Gallus gallus* Pro-neuregulin-1, Uniprot ID F1NUM4 (SEQ ID NO:461); *Rattus norvegicus* Neuregulin 1, isoform, Uniprot ID A0A0G2K3Q3 (SEQ ID NO:462); *Pelodiscus sinensis* Neuregulin 1, Uniprot ID K7FXL6 (SEQ ID NO:463); *Macaca mulatta* Neuregulin 1, Uniprot ID F7HH69 (SEQ ID NO:464); *Gallus gallus* Pro-neuregulin-1, Uniprot ID Q05199 (SEQ ID NO:465); *Xenopus laevis* Pro-neuregulin-1, Uniprot ID O93383 (SEQ ID NO:466); *Danio rerio* Neuregulin 1, Uniprot ID B3DK99 (SEQ ID NO:467); etc.

Force sensor cleavage domains that may find use in the instant chimeric polypeptides include adhesion-GPCR cleavage domains. Useful adhesion-GPCR cleavage domains will vary and may be derived from an adhesion-GPCR protein (e.g., *Drosophila* Flamingo) or homolog thereof and will generally include at least one proteolytic cleavage site of the adhesion-GPCR protein. In some instances, an adhesion-GPCR polypeptide included in a chimeric polypeptide of the present disclosure may be a mammalian adhesion-GPCR cleavage domain or a variant thereof, including but not limited to e.g., human, non-human primate, rodent (e.g., mouse, rat, etc.), and the like adhesion-GPCR cleavage domains and homologs and variants thereof. Useful adhesion-GPCR cleavage domains may include those adhesion-GPCR cleavage domains that are naturally occurring or non-natural variants thereof, including e.g., domains having less than 100% sequence identity with a naturally occurring adhesion-GPCR cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring adhesion-GPCR cleavage domain (including e.g., mammalian and/or non-mammalian adhesion-GPCR cleavage domains).

Useful adhesion-GPCR cleavage domains may include e.g., those derived from accession number GenBank BAA84069.1 (SEQ ID NO:271) or a homolog or variant thereof, including e.g.: PRNPQCVRWNSFTNRWT-RLGCQTEIPDFDGDFNPAAQQAILVNCSCTHISSYAV-IVDVIDPEDIPE PSLLVQR (SEQ ID NO:272) or ITYPSE-QMQQSEQVVYRSLGSPHLAQPIKLQMWLDVDSAR-FGPRSNPQCVRWNSFTNRWTRLG CQTEIPDFDG-DFNPAAQQAILVNCSCTHISSYAVIVDVIDPEDIPEPS-LLVQR (SEQ ID NO:273), or a polypeptide having less than 100% sequence identity with the preceding sequence or another sequence derived from the protein of the provided accession number, including e.g., at least 99% sequence identity, at least 98%, at least 97%, at least 96%, at least 95%, at least 90%, at least 85%, at least 80%, at least 75%, at least 70%, at least 65% or at least 60% sequence identity with one or more of the provided sequences.

Subject adhesion-GPCR cleavage domains may be derived from or include a portion of a sequence from a wide variety of adhesion-GPCR protein sequences. Useful adhesion-GPCR proteins from which an adhesion-GPCR cleavage domain may be derived or from which sequence may be used in developing an adhesion-GPCR cleavage domain include but are not limited to the following proteins and/or homologs thereof, including e.g., *Drosophila melanogaster* flamingo, Uniprot ID Q9V5N8 (SEQ ID NO:468); *Trichinella pseudospiralis* flamingo, Uniprot ID A0A0V1EBA4 (SEQ ID NO:469); *Cyphomyrmex costatus* flamingo, Uniprot ID A0A151IHF5 (SEQ ID NO:470); *Drosophila ficusphila* flamingo, Uniprot ID A0A1W4VQX0 (SEQ ID NO:471); *Mus musculus* CELSR1, Uniprot ID O35161 (SEQ ID NO:472); *Homo sapiens* CELSR1, Uniprot ID Q9NYQ6 (SEQ ID NO:473); *Mus musculus* CELSR2, Uniprot ID Q9R0M0 (SEQ ID NO:474); *Homo sapiens* CELSR3, Uniprot ID Q9NYQ7 (SEQ ID NO:475); *Mus musculus* CELSR3, Uniprot ID Q91ZI0 (SEQ ID NO:476); *Homo sapiens* CELSR2, Uniprot ID Q9HCU4 (SEQ ID NO:477); *Rattus norvegicus* CELSR3, Uniprot ID O88278 (SEQ ID NO:478); *Rattus norvegicus* CELSR2, Uniprot ID Q9QYP2 (SEQ ID NO:479); *Macaca mulatta* CELSR1, Uniprot ID F7HKR3 (SEQ ID NO:480); *Rattus norvegicus* CELSR1, Uniprot ID F1MAS4 (SEQ ID NO:481); *Canis lupus familiaris* CELSR1, Uniprot ID F1PLY1 (SEQ ID NO:482); *Cavia porcellus* CELSR1, Uniprot ID H0VPZ8 (SEQ ID NO:483); *Felis catus* CELSR1, Uniprot ID M3W630 (SEQ ID NO:484); *Equus caballus* CELSR1, Uniprot ID F7C292 (SEQ ID NO:485); *Gorilla gorilla gorilla* CELSR1, Uniprot ID G3QD92 (SEQ ID NO:486); *Danio rerio* CELSR2, Uniprot ID A0JBX1 (SEQ ID NO:487); *Bos taurus* CELSR3, Uniprot ID F1MHH5 (SEQ ID NO:488); *Equus caballus* CELSR3, Uniprot ID F6X224 (SEQ ID NO:489); *Mus musculus* Celsr3, Uniprot ID A0A076N9U7 (SEQ ID NO:490); etc.

Force sensor cleavage domains that may find use in the instant chimeric polypeptides include synthetic cleavage domains, including e.g., flagellin-derived cleavage domains. Useful flagellin-derived cleavage domains will vary and may be derived from a flagellin protein or homolog thereof and will generally include at least one proteolytic cleavage site. Useful synthetic cleavage domains may include, e.g., PRGPGGAGPGGAGPGGAGPGGAGPGGAGPGGAG-PGGAGPGGARR (SEQ ID NO:274) including e.g., domains having less than 100% sequence identity with synthetic cleavage domain, including one or more of the domains provided herein, such as less than 100% but at least 40%, at least 50%, at least 60%, at least 70%, at least 75%, at least 80%, at least 85%, at least 90%, at least 95%, at least 96%, at least 97%, at least 98% or at least 99% sequence identity with a naturally occurring synthetic cleavage domain (including e.g., the synthetic domain provided above).

The subject cleavage domains (including e.g., those provided above) may be included in the chimeric polypeptides of the subject disclosure at any convenient and appropriate location that may vary, e.g., depending on the length of the cleavage domain, the inclusion or exclusion of additional domains (i.e., domains besides the cleavage domain) of the protein from which the cleavage domain is derived in the chimeric polypeptide, the presence or absence of other domains, e.g., as described herein, within the chimeric polypeptide, and the like. In some embodiments, the cleavage domain may be positioned within the chimeric polypeptide essentially as described for the vWF cleavage domain(s) described herein. In some embodiments, a subject cleavage domain may be inserted within the chimeric polypeptide following a Notch domain, e.g., following and/or adjacent to a PPANVKYV (SEQ ID NO:275) of a Notch domain), or the like. Useful force sensor cleavage domains will vary in length, including e.g., where the overall length of the force sensor cleavage domain is 1000 amino acids or less, including e.g., 900 amino acids or less, 800 amino acids or less, 700 amino acids or less, 600 amino acids or less, 500 amino acids or less, 400 amino acids or less, 300 amino acids or less, 200 amino acids or less, 100 amino acids or less or 50 amino acids or less. In some instances, the subject force sensor cleavage domain may range from less than 40 to more than 1000 amino acid in length, including but not limited to e.g., from 40 to 1000, from 50 to 1000, from 75 to 1000, from 100 to 1000, from 125 to 1000, from 150 to 1000, from 150 to 900, from 150 to 800, from 150 to 700, from 150 to 600, from 150 to 500, from 150 to 400, from 150 to 350, from 150 to 300, from 150 to 275, from 150 to 250, from 150 to 225, from 150 to 200, from 40 to 900, from 40 to 800, from 40 to 700, from 40 to 600, from 40 to 500, from 40 to 400, from 40 to 350, from 40 to 300, from 40 to 275, from 40 to 250, from 40 to 225, from 40 to 200, from 40 to 100 or the like.

In some instances, a force sensor cleavage domain may include sequence of a force sensitive protein in the N- and/or C-terminal direction adjacent to a force sensor cleavage domain, including up to 100 amino acids or more in the N- and/or C-terminal direction adjacent to the force sensor cleavage domain, including but not limited to e.g., 100 amino acids or less, 90 amino acids or less, 80 amino acids or less, 70 amino acids or less, 60 amino acids or less, 50 amino acids or less, 40 amino acids or less, 30 amino acids or less, 20 amino acids or less, 10 amino acids or less, etc., in the N- and/or C-terminal direction adjacent to a force sensor cleavage domain.

Chimeric polypeptides of the present disclosure will generally include a transmembrane domain Useful transmembrane domains include those having a proteolytic cleavage site (i.e., cleavable transmembrane domains). Proteolytic cleavage of a cleavable transmembrane domain of a chimeric polypeptide of the present disclosure will generally be prevented prior to cleavage of the chimeric polypeptide at the force sensor cleavage domain. Put another way, within a chimeric polypeptide of the instant disclosure, cleavage at a cleavable transmembrane domain cleavage site may be blocked, e.g., blocked by one or more ectodomains of the chimeric polypeptide, until the chimeric polypeptide is cleaved at a proteolytic cleavage site within the force sensor cleavage domain. Thus, cleavage of a chimeric polypeptide at a proteolytic cleavage site within the force sensor cleavage domain may thereby expose a cleavage site of the cleavable transmembrane domain, i.e., exposing an otherwise inaccessible transmembrane domain cleavage site to cleavage by a protease. The process whereby removal of one or more ectodomains is required for cleavage of a cleavable transmembrane domain may also be referred to as ectodomain shedding. As such, in some instances, ectodomain shedding by cleavage at a force sensor cleavage domain may provide for subsequent cleavage at a transmembrane domain cleavage site.

The protease that cleaves an exposed transmembrane domain cleavage site, and any associated factors necessary for this function, may be widely present (i.e., endogenously present in various different cell types, endogenously present in various different organisms, etc.) such that exposure of the cleavage site results in efficient and rapid cleavage, e.g., without a need for heterologous expression of the protease or any factors that associate with the protease to facilitate cleavage. However, the use of a cleavable transmembrane domain with a cleavage site cleaved by a widely present protease does not preclude the heterologous expression of the protease (or one or more associated factors) within a system of the present disclosure.

Various cleavable transmembrane domains may find use in the subject chimeric polypeptides. For example, in some instances, useful cleavable transmembrane domains include those having, either naturally or artificially, a γ-secretase cleavage site. Substrates of γ-secretase include e.g., Alcadein α, Alcadein γ (calsyntenin), APLP1, APLP2, ApoER2, APP, AβPP, Betacellulin (BTC), Betaglycan, CD43, CD44, CSF1R, CX3CL1 (fractalkine), CXCL16, DCC, Delta1, Desmoglein-2, DNER, Dystroglycan, E-cadherin, EpCAM, EphA4, EphB2, EphrinB1, EphrinB2, ErbB4, GHR, HLA, HLA-A2, IFNaR2, IGF-1R, IL-1R1, IL-1R2, IL6R, IR, Ire1 β, Ire1α, Jagged2, KCNE1, KCNE2, KCNE3, KCNE4, Klotho, L1, LAR, LRP1 (LDLR), LRP1B, LRP2 (megalin), LRP6, MUC1, Nav-β1, Nav-β2, Nav-β3, Nav-β34, N-cadherin, Nectin-1α, Neuregulin-1, Neuregulin-2, Notch1, Notch2, Notch3, Notch4, NPR-C, NRADD, p75-NTR, PAM, PLXDC2, Polyductin (PKHD1), Protocadherin-α4 (Pcdh-α4), Protocadherin-γ-C3 (Pcdh-γC3), PTP-LAR, Ptprz, RAGE, ROBO1, RPTPκ, RPTPµ, SorC3, SorCS1b, SorLA (LR11), Sortilin, Syndecan-1, Syndecan-2, Syndecan-3, Tie1, Tyrosinase, TYRP1, TYRP2, Vasorin, VE-cadherin, VEGF-R1, VGSC beta2, VLDLR, as well as those described in Bed & Sanders (Cell Mol Life Sci. (2008) 65(9):1311-1334) and Haapasalo & Kovacs (J Alzheimers Dis. (2011) 25(1):3-28); the disclosures of which are incorporated herein by reference in their entirety.

Useful transmembrane domains include but are not limited to Notch transmembrane domains, including e.g., invertebrate and vertebrate Notch transmembrane domains, including e.g., insect (e.g., drosophila) Notch transmembrane domains, mammalian (e.g., human, non-human primate, rodent (e.g., mouse, rat, etc.), etc.) Notch transmembrane domains, and the like. Notch transmembrane domains are generally cleavable transmembrane domains, as described herein, and may, e.g., include a γ-secretase cleavage site, including natural and modified γ-secretase cleavage sites, including e.g., a Notch S3 proteolytic cleavage site.

Useful Notch transmembrane domains include but are not limited to e.g., Notch 1, Notch 2, Notch 3 and Notch 4 transmembrane domains. Non-limiting examples of Notch transmembrane domains include but are not limited to e.g., FMYVAAAAFVLLFFVGCGVLL (SEQ ID NO:144), LLYLLAVAVVIILFIILLGVI (SEQ ID NO:145), LPLLVAGAVLLLVILVLGVMV (SEQ ID NO:146), PVLCSPVAGVILLALGALLVL (SEQ ID NO:147), LMYVAAAAFVLLFFVGCGVLL (SEQ ID NO:148), LLYLLAVAVVIILFFILLGVI (SEQ ID NO:149), LLPLLVAGAVFLLIIFILGVM (SEQ ID NO:150), PILCSPVVGVLLLALGALLVL (SEQ ID NO:151), LHLMYVAAAAFVLLFFVGCGVLL (SEQ ID NO:152), LLYLLAVAVVIILFLILLGVI (SEQ ID NO:153), LPLLVAGAVFLLVIFVLGVMV (SEQ ID NO:154), and variants thereof.

A Notch transmembrane domain or a portion thereof utilized in a chimeric polypeptide of the present disclosure may include an S3 cleavage site (i.e., a gamma-secretase cleavage site). As such, an S3 proteolytic cleavage site can be located within the TM domain. The S3 proteolytic cleavage site may be cleaved by gamma-secretase (γ-secretase). A γ-secretase cleavage site can comprise a Gly-Val dipeptide sequence, where the enzyme cleaves between the Gly and the Val. For example, in some cases, an S3 proteolytic cleavage site has the amino acid sequence VGCGVLLS (SEQ ID NO:155), where cleavage occurs between the "GV" sequence. In some cases, an S3 proteolytic cleavage site comprises the amino acid sequence GCGVLLS (SEQ ID NO:156).

In some instances, a chimeric polypeptide of the present disclosure may exclude one or more Notch proteolytic cleavage sites, including e.g., where such a chimeric polypeptide excludes a S1 site, a S2 site or both. An S1 proteolytic cleavage site can be located between the HD-N segment and the HD-C segment of a Notch polypeptide. In some cases, the S1 proteolytic cleavage site is a furin-like protease cleavage site. A furin-like protease cleavage site can have the canonical sequence Arg-X-(Arg/Lys)-Arg (SEQ ID NO:157), where X is any amino acid; the protease cleaves immediately C-terminal to the canonical sequence. For example, in some cases, an amino acid sequence comprising an S1 proteolytic cleavage site can have the amino acid sequence GRRRRELDPM (SEQ ID NO:158), where cleavage occurs between the "RE" sequence. As another example, an amino acid sequence comprising an S1 proteolytic cleavage site can have the amino acid sequence RQRRELDPM (SEQ ID NO:159), where cleavage occurs between the "RE" sequence.

An S2 proteolytic cleavage site can be located within the HD-C segment. In some cases, the S2 proteolytic cleavage site is an ADAM family type protease cleavage site, such as e.g., an ADAM-17-type protease cleavage site. An ADAM-17-type protease cleavage site can comprise an Ala-Val dipeptide sequence, where the enzyme cleaves between the Ala and the Val. For example, in some cases, amino acid sequence comprising an S2 proteolytic cleavage site can have the amino acid sequence KIEAVKSE (SEQ ID NO:160), where cleavage occurs between the "AV" sequence. As another example, an amino acid sequence comprising an S2 proteolytic cleavage site can have the amino acid sequence KIEAVQSE (SEQ ID NO:161), where cleavage occurs between the "AV" sequence.

In some instances, chimeric polypeptides of the present disclosure may include a Notch extracellular domain, i.e., at least a portion of a Notch sequence present on the extracellular side of the transmembrane domain, including e.g., immediately adjacent to the transmembrane domain. As such, a chimeric polypeptide of the present disclosure may include a Notch extracellular domain interposed between the force sensor cleavage domain and the cleavable transmembrane domain. Such Notch extracellular domains may, in some instances, exclude one or more domains, including all domains, necessary for Notch to bind a Notch ligand, e.g., Delta. Accordingly, Notch domains present in chimeric polypeptides of the present disclosure may not have Notch-ligand binding functionality, including where such a lack of functionality is due to the absence of Notch-ligand binding domains or mutation of Notch-ligand binding domains to render them non-functional.

Notch extracellular domains, where present in chimeric polypeptides of the present disclosure, may, e.g., include an extracellular portion of a Notch polypeptide, including e.g., where such portion extends from between the Notch S2 site and the transmembrane domain of the Notch polypeptide or is a portion of a Notch protein extending from the Notch S2 site and the transmembrane domain. Variants of such regions may also be employed. Accordingly, useful Notch extracellular domains will vary and may include at least one extracellular amino acid of a Notch polypeptide and up to 15 or more amino acids, including but not limited to e.g., 1 to 15, 5 to 15, 10 to 15, 1 to 10, 1 to 5, 2 to 15, 2 to 10, 2 to 5, 3 to 15, 3 to 10, 4 to 15, 4 to 10, etc. In some embodiments, useful Notch extracellular domains may include the amino acid sequence SQLH (SEQ ID NO:162) or a portion thereof. In some embodiments, useful Notch extracellular domains may include the amino acid sequence KSEPVEPPLPSQLH (SEQ ID NO:163) or a portion thereof. Corresponding domains of differing sequence, of equal, greater or lesser length, may be readily identified or designed, e.g., through alignment of homologous Notch polypeptides.

In some instances, chimeric polypeptides of the present disclosure may include a Notch cytoplasmic domain, i.e., at least a portion of a Notch sequence present on the cytoplasmic side of the transmembrane domain, including e.g., immediately adjacent to the transmembrane domain. As such, a chimeric polypeptide of the present disclosure may include a Notch cytoplasmic domain interposed between the cleavable transmembrane domain and the intracellular domain of the chimeric polypeptide.

In instances where the chimeric polypeptide includes a Notch intracellular domain (i e, an intracellular domain derived from a Notch polypeptide that includes a Notch effector domain (i e, a domain that induces expression of Notch target genes) the Notch cytoplasmic domain may include the Notch intracellular domain or the two domains may be adjacent.

In some embodiments, a Notch cytoplasmic domain included in a chimeric polypeptide of the subject disclosure may be incapable or insufficient to induce downstream Notch signaling. Such Notch cytoplasmic domains may, in some instances, exclude one or more domains, including all domains, necessary for Notch to induce canonical or non-canonical Notch signaling, including by inducing expression of Notch target genes. Accordingly, Notch domains present in chimeric polypeptides of the present disclosure may not have Notch signaling functionality, including where such a lack of functionality is due to the absence of Notch intracellular signaling domains or mutation of a Notch intracellular signaling domain to render it non-functional.

Notch cytoplasmic domains, where present in chimeric polypeptides of the present disclosure, may, e.g., include a cytoplasmic portion of a Notch polypeptide, including e.g., where such portion extends from between the transmembrane domain of the Notch polypeptide and the most N-terminal ankyrin repeat (ANK) domain of the Notch polypeptide or is a portion of a Notch protein extending from the transmembrane domain and the most N-terminal ANK domain Variants of such regions may also be employed. Accordingly, useful Notch extracellular domains will vary and may include at least one cytoplasmic amino acid of a Notch polypeptide and up to 40 or more amino acids, including but not limited to e.g., 1 to 40, 5 to 40, 10 to 40, 15 to 40, 20 to 40, 25 to 40, 30 to 40, 35 to 40, 1 to 37, 5 to 37, 10 to 37, 15 to 37, 20 to 37, 25 to 37, 30 to 37, 1 to 35, 5 to 35, 10 to 35, 15 to 35, 20 to 35, 25 to 35, 30 to 35, 2 to 40, 2 to 35, 2 to 30, 2 to 25, 2 to 20, 2 to 15, 2 to 10, 5 to 30, 5 to 25, 5 to 20, 5 to 15, 5 to 10, etc. In some embodiments, useful Notch cytoplasmic domains may include the amino acid sequence SRKRRR (SEQ ID NO:164) or a portion thereof. In some embodiments, useful Notch cytoplasmic domains may include the amino acid sequence SRKRRRQLCIQKL (SEQ ID NO:165) or a portion thereof. In some embodiments, useful Notch cytoplasmic domains may include the amino acid sequence SRKRRRQHGQLWFPEGFKVSEASKKKRREPLG (SEQ ID NO:166) or a portion thereof. Corresponding domains of differing sequence, of equal, greater or lesser length, may be readily identified or designed, e.g., through alignment of homologous Notch polypeptides.

In some instances, a chimeric polypeptide of the present disclosure may include a Notch extracellular domain that is adjacent to a Notch transmembrane domain that is adjacent to a Notch cytoplasmic domain (i.e., Notch extracellular domain—Notch transmembrane domain—Notch cytoplasmic domain in covalent linkage with no intervening domains). In some embodiments, useful linked Notch extracellular-transmembrane-cytoplasmic domains may include the amino acid sequence SQLHLMYVAAAAFVLL-FFVGCGVLLSRKRRR (SEQ ID NO:167) or a portion thereof. In some embodiments, useful linked Notch extracellular-transmembrane-cytoplasmic domains may include the amino acid sequence KSEPVEPPLPSQLHLMY-VAAAAFVLLFFVGCGVLLSRKRRR (SEQ ID NO:168) or a portion thereof. In some embodiments, useful linked Notch extracellular-transmembrane-cytoplasmic domains may include the amino acid sequence FMYVAAAAFVLL-FFVGCGVLLSRKRRRQHGQLWFPEGFKVSEASKKKR-REPLG (SEQ ID NO:169) or a portion thereof. In some instances, a modified variant of such a domain may be employed.

Subject Notch regions, e.g., as described above, of chimeric polypeptides of the present disclosure may include or exclude various components (e.g., domains, cleavage sites, etc.) thereof. Examples of such components of Notch regions that may be present or absent in whole or in part, as appropriate, include e.g., one or more EGF-like repeat domains, one or more Lin12/Notch repeat domains, one or more heterodimerization domains (e.g., HD-N or HD-C), a transmembrane domain, one or more proteolytic cleavage sites (e.g., a furin-like protease site (e.g., an S1 site), an ADAM-family protease site (e.g., an S2 site) and/or a gamma-secretase protease site (e.g., an S3 site)), and the like. Chimeric polypeptides of the present disclosure may, in some instances, exclude all or a portion of one or more Notch extracellular domains, including e.g., Notch-ligand binding domains such as Delta-binding domains. Chimeric polypeptides of the present disclosure may, in some instances, include one or more non-functional versions of one or more Notch extracellular domains, including e.g., Notch-ligand binding domains such as Delta-binding domains. Chimeric polypeptides of the present disclosure may, in some instances, exclude all or a portion of one or more Notch intracellular domains, including e.g., Notch Rbp-associated molecule domains (i.e., RAM domains), Notch Ankyrin repeat domains, Notch transactivation domains, Notch PEST domains, and the like. Chimeric polypeptides of the present disclosure may, in some instances, include one or more non-functional versions of one or more Notch intracellular domains, including e.g., non-functional Notch Rbp-associated molecule domains (i.e., RAM domains), non-functional Notch Ankyrin repeat domains, non-functional Notch transactivation domains, non-functional Notch PEST domains, and the like.

As summarized above, binding of a specific binding member by its binding partner generally induces cleavage of the chimeric polypeptide at the proteolytic cleavage site present within the force sensor cleavage domain, thereby releasing the intracellular domain. Release of the intracellular domain may modulate an activity of a cell or generally trigger the production of a payload that is contained within the cell, expressed on the cell surface or secreted. The chimeric polypeptides of the instant disclosure will generally include at least one sequence that is heterologous to the force sensitive protein from which the force sensor domain is derived and Notch receptor polypeptides (i.e., a domain that is not derived from either a force sensitive protein identified herein (e.g., vWF) or a Notch receptor), including e.g., where the extracellular domain is heterologous to Notch receptor polypeptides and the force sensitive proteins identified herein, where the intracellular domain is heterologous to Notch receptor polypeptides and/or one or more force sensitive proteins identified herein, where both the extracellular domain and the intracellular domain are heterologous to Notch receptor polypeptides and one or more force sensitive proteins identified herein, etc.

Domains, e.g., the extracellular domain, the force sensor cleavage domain, the intracellular domain, etc., may be joined directly, i.e., with no intervening amino acid residues or may include a peptide linker that joins two domains. Peptide linkers may be synthetic or naturally derived including e.g., a fragment of a naturally occurring polypeptide.

A peptide linker can vary in length of from about 3 amino acids (aa) or less to about 200 aa or more, including but not limited to e.g., from 3 aa to 10 aa, from 5 aa to 15 aa, from 10 aa to 25 aa, from 25 aa to 50 aa, from 50 aa to 75 aa, from 75 aa to 100 aa, from 100 aa to 125 aa, from 125 aa to 150 aa, from 150 aa to 175 aa, or from 175 aa to 200 aa. A peptide linker can have a length of from 3 aa to 30 aa, e.g., 3, 4, 5, 6, 7, 8, 9, 10, 11, 12, 13, 14, 15, 16, 17, 18, 19, 20, 21, 22, 23, 24, 25, 26, 27, 28, 29, or 30 aa. A peptide linker can have a length of from 5 aa to 50 aa, e.g., from 5 aa to 40 aa, from 5 aa to 35 aa, from 5 aa to 30 aa, from 5 aa to 25 aa, from 5 aa to 20 aa, from 5 aa to 15 aa or from 5 aa to 10 aa.

Extracellular Domains

Proteolytically cleavable chimeric polypeptides of the instant disclosure will generally include an extracellular domain that includes a specific binding member that specifically binds to a specific binding partner. In some instances, such a specific binding member-partner pair may be referred to as a "specific binding pair" and the members thereof may be referred to "first" and "second" binding partners of the pair. Binding of the specific binding member to its specific binding partner triggers proteolytic cleavage at the force sensor cleavage domain, releasing the intracellular domain which modulates an activity of the cell expressing the chimeric polypeptide.

The extracellular domain generally comprises a first member of a specific binding pair that is heterologous to one or more force sensitive proteins, including the protein from which the force sensor cleavable domain of the chimeric polypeptide is derived. The extracellular domain may also comprises a first member of a specific binding pair that is heterologous to Notch receptor polypeptides, including e.g., any Notch receptor polypeptide or portion thereof present in the chimeric polypeptide. In other words, in many instances, the first member of the specific binding pair present in the extracellular domain is not naturally present in a force sensitive protein, including a force sensitive protein identified herein, or Notch receptor polypeptide.

The specific binding member of the extracellular domain generally determines the specificity of the chimeric polypeptide. In some instances, a chimeric polypeptide may be referred to according to its specificity as determined based on its specific binding member. For example, a specific binding member having binding partner "X" may be referred to as an X chimeric polypeptide or an anti-X chimeric polypeptide.

Any convenient specific binding pair, i.e., specific binding member and specific binding partner pair, may find use in the chimeric polypeptides of the instant disclosure including but not limited to e.g., antigen-antibody pairs, ligand receptor pairs, scaffold protein pairs, etc. In some instances, the specific binding member may be an antibody and its binding partner may be an antigen to which the antibody specifically binds. In some instances, the specific binding member may be a receptor and its binding partner may be a ligand to which the receptor specifically binds. In some instances, the specific binding member may be a scaffold protein and its binding partner may be a protein to which the scaffold protein specifically binds.

Suitable first members of a specific binding pairs include, but are not limited to, antibody-based recognition scaffolds; antibodies (i.e., an antibody-based recognition scaffold, including antigen-binding antibody fragments); non-antibody-based recognition scaffolds; antigens (e.g., endogenous antigens; exogenous antigens; etc.); a ligand for a receptor; a receptor; a target of a non-antibody-based recognition scaffold; an Fc receptor (e.g., FcγRIIIa; FcγRIIIb; etc.); an extracellular matrix component; and the like.

In some cases, the specific binding member of the chimeric polypeptide is an antibody. The antibody can be any antigen-binding antibody-based polypeptide, a wide variety of which are known in the art. In some instances, the specific binding member is or includes a monoclonal antibody, a single chain Fv (scFv), a Fab, etc. Other antibody based recognition domains (cAb VHH (camelid antibody variable domains) and humanized versions, IgNAR VH (shark antibody variable domains) and humanized versions, sdAb VH (single domain antibody variable domains) and "camelized" antibody variable domains are suitable for use. In some instances, T-cell receptor (TCR) based recognition domains such as single chain TCR (scTv, single chain two-domain TCR containing Vα Vβ) are also suitable for use.

Where the specific binding member of a chimeric polypeptide of the present disclosure is an antibody-based binding member, the chimeric polypeptide can be activated in the presence of a binding partner to the antibody-based binding member, including e.g., an antigen specifically bound by the antibody-based binding member. In some instances, antibody-based binding member may be defined, as is commonly done in the relevant art, based on the antigen bound by the antibody-based binding member, including e.g., where the antibody-based binding member is described as an "anti-" antigen antibody, e.g., an anti-CD19 antibody. Accordingly, antibody-based binding members suitable for inclusion in a chimeric polypeptide of the present disclosure can have a variety of antigen-binding specificities.

Useful antibody-based specific binding members may, in some instances, include the antigen binding domain of a therapeutic antibody, including but not limited to e.g., an antigen binding domain of: 8H9, Abagovomab, Abciximab, Abituzumab, Abrilumab, Actoxumab, Aducanumab, Afelimomab, Afutuzumab, Alacizumab pegol, ALD518, Alirocumab, Altumomab pentetate, Amatuximab, Anatumomab mafenatox, Anetumab ravtansine, Anifrolumab, Anrukinzumab, Apolizumab, Arcitumomab, Ascrinvacumab, Aselizumab, Atezolizumab, Atinumab, Atlizumab/tocilizumab, Atorolimumab, Bapineuzumab, Basiliximab, Bavituximab, Bectumomab, Begelomab, Benralizumab, Bertilimumab, Besilesomab, Bevacizumab/Ranibizumab, Bezlotoxumab, Biciromab, Bimagrumab, Bimekizumab, Bivatuzumab mertansine, Blosozumab, Bococizumab, Brentuximabvedotin, Brodalumab, Brolucizumab, Brontictuzumab, Cantuzumab mertansine, Cantuzumab ravtansine, Caplacizumab, Capromab pendetide, Carlumab, Catumaxomab, cBR96-doxorubicin immunoconjugate, Cedelizumab, Ch.14.18, Citatuzumab bogatox, Cixutumumab, Clazakizumab, Clenoliximab, Clivatuzumab tetraxetan, Codrituzumab, Coltuximab ravtansine, Conatumumab, Concizumab, CR6261, Crenezumab, Dacetuzumab, Daclizumab, Dalotuzumab, Dapirolizumab pegol, Daratumumab, Dectrekumab, Demcizumab, Denintuzumab mafodotin, Derlotuximab biotin, Detumomab, Dinutuximab, Diridavumab, Dorlimomab aritox, Drozitumab, Duligotumab, Dupilumab, Durvalumab, Dusigitumab, Ecromeximab, Edobacomab, Edrecolomab, Efalizumab, Efungumab, Eldelumab, Elgemtumab, Elotuzumab, Elsilimomab, Emactuzumab, Emibetuzumab, Enavatuzumab, Enfortumab vedotin, Enlimomab pegol, Enoblituzumab, Enokizumab, Enoticumab, Ensituximab, Epitumomab cituxetan, Erlizumab, Ertumaxomab, Etrolizumab, Evinacumab, Evolocumab, Exbivirumab, Fanolesomab, Faralimomab, Farletuzumab, Fasinumab, FBTA05, Felvizumab, Fezakinumab, Ficlatuzumab, Figitumumab, Firivumab, Flanvotumab, Fletikumab, Fontolizumab, Foralumab, Foravirumab, Fresolimumab, Fulranumab, Futuximab, Galiximab, Ganitumab, Gantenerumab, Gavilimomab, Gevokizumab, Girentuximab, Glembatumumab vedotin, Gomiliximab, Guselkumab, Ibalizumab, Ibalizumab, Icrucumab, Idarucizumab, Igovomab, IMAB362, Imalumab, Imciromab, Imgatuzumab, Inclacumab, Indatuximab ravtansine, Indusatumab vedotin, Inolimomab, Inotuzumab ozogamicin, Intetumumab, fratumumab, Isatuximab, Itolizumab, Ixekizumab, Keliximab, Lambrolizumab, Lampalizumab, Lebrikizumab, Lemalesomab, Lenzilumab, Lerdelimumab, Lexatumumab, Libivirumab, Lifastuzumab vedotin, Ligelizumab, Lilotomab satetraxetan, Lintuzumab, Lirilumab, Lodelcizumab, Lokivetmab, Lorvotuzumab mertansine, Lucatumumab, Lulizumab pegol, Lumiliximab, Lumretuzumab, Margetuximab, Maslimomab, Matuzumab, Mavrilimumab, Metelimumab, Milatuzumab, Minretumomab, Mirvetuximab soravtansine, Mitumomab, Mogamulizumab, Morolimumab, Morolimumab immune, Motavizumab, Moxetumomab pasudotox, Muromonab-CD3, Nacolomab tafenatox, Namilumab, Naptumomab estafenatox, Narnatumab, Nebacumab, Necitumumab, Nemolizumab, Nerelimomab, Nesvacumab, Nofetumomab merpentan, Obiltoxaximab, Obinutuzumab, Ocaratuzumab, Odulimomab, Olaratumab, Olokizumab, Onartuzumab, Ontuxizumab, Opicinumab, Oportuzumab monatox, Orticumab, Otlertuzumab, Oxelumab, Ozanezumab, Ozoralizumab, Pagibaximab, Palivizumab, Pankomab, Panobacumab, Parsatuzumab, Pascolizumab, Pasotuxizumab, Pateclizumab, Patritumab, Perakizumab, Pexelizumab, Pinatuzumab vedotin, Pintumomab, Placulumab, Polatuzumab vedotin, Ponezumab, Priliximab, Pritoxaximab, Pritumumab, PRO 140, Quilizumab, Racotumomab, Radretumab, Rafivirumab, Ralpancizumab, Ramucirumab, Ranibizumab, Raxibacumab, Refanezumab, Regavirumab, Rilotumumab, Rinucumab, Robatumumab, Roledumab, Romosozumab, Rontalizumab, Rovelizumab, Ruplizumab, Sacituzumab govitecan, Samalizumab, Sarilumab, Satumomab pendetide, Secukinumab, Seribantumab, Setoxaximab, Sevirumab, SGN-CD19A, SGN-CD33A, Sifalimumab, Siltuximab, Simtuzumab, Siplizumab, Sirukumab, Sofituzumab vedotin, Solanezumab, Solitomab, Sonepcizumab, Sontuzumab, Stamulumab, Sulesomab, Suvizumab, Tabalumab, Tacatuzumab tetraxetan, Tadocizumab, Talizumab, Tanezumab, Taplitumomab paptox, Tarextumab, Tefibazumab, Telimomab aritox, Tenatumomab, Teneliximab, Teprotumumab, Tesidolumab, Tetulomab, TGN1412, Ticilimumab/tremelimumab, Tigatuzumab, Tildrakizumab, TNX-650, Toralizumab, Tosatoxumab, Tovetumab, Tralokinumab, TRBS07, Tregalizumab, Trevogrumab, Tucotuzumab celmoleukin, Tuvirumab, Ublituximab, Ulocuplumab, Urelumab, Urtoxazumab, Vandortuzumab vedotin, Vantictumab, Vanucizumab, Vapaliximab, Varlilumab, Vatelizumab, Veltuzumab, Vepalimomab, Vesencumab, Visilizumab, Vorsetuzumab mafodotin, Votumumab, Zalutumumab, Zanolimumab, Zatuximab, Ziralimumab, Zolimomab aritox, or the like.

Specific binding pairs include, e.g., antigen-antibody specific binding pairs, where the first member is an antibody (or antibody-based recognition scaffold) that binds specifically to the second member, which is an antigen, or where the first member is an antigen and the second member is an antibody (or antibody-based recognition scaffold) that binds specifically to the antigen; ligand-receptor specific binding pairs, where the first member is a ligand and the second member is a receptor to which the ligand binds, or where the first member is a receptor, and the second member is a ligand that binds to the receptor; non-antibody-based recognition scaffold-target specific binding pairs, where the first member is a non-antibody-based recognition scaffold and the second member is a target that binds to the non-antibody-based recognition scaffold, or where the first member is a target and the second member is a non-antibody-based recognition scaffold that binds to the target; adhesion molecule-extracellular matrix binding pairs; Fc receptor-Fc binding pairs, where the first member comprises an immunoglobulin Fc that binds to the second member, which is an Fc receptor, or where the first member is an Fc receptor that binds to the second member which comprises an immunoglobulin Fc; and receptor-co-receptor binding pairs, where the first member is a receptor that binds specifically to the second member which is a co-receptor, or where the first member is a co-receptor that binds specifically to the second member which is a receptor.

Non-limiting examples of suitable extracellular domains include, e.g., Cadherins (CDH1-20), Integrins (alfa and beta isoforms), Ephrins, NCAMs, connexins, CD44, syndecan, CD47, DGalfa/beta, SV2, protocadherin, Fas, Dectin-1, CD7, CD40, Neuregulin, KIR, BTLA, Tim-2, Lag-3, CD19, CTLA4, CD28, TIGIT, and ICOS.

In some cases, the extracellular domain comprises a toll-like receptor (TLR). In some cases, the extracellular domain comprises a dectin that recognizes N-glycans that are present on the surface of pathogenic fungi and cancer cells. See, e.g., Xie (2012) Glycoconj. 29:273; and Brown et al. (2007) Protein Sci. 16:1042. In some cases, the extracellular domain comprises a polypeptide that recognizes a bacterial surface molecule.

A skilled artisan can select an extracellular domain based on the desired localization or function of a cell that is genetically modified to express a chimeric polypeptide of the present disclosure. For example, the extracellular domain can target cells to estrogen-dependent breast cancer cells that have an increased number of estrogen receptors on the cell surface, where the first member of the specific binding pair binds to an estrogen receptor (second member of the specific binding pair). Other non-limiting examples of ligand/receptor interactions include CCRI (e.g., for targeting to inflamed joint tissues or brain in rheumatoid arthritis, and/or multiple sclerosis), CCR7, CCR8 (e.g., targeting to lymph node tissue), CCR6, CCR9, CCRIO (e.g., to target to intestinal tissue), CCR4, CCRIO (e.g., for targeting to skin), CXCR4 (e.g., for general enhanced transmigration), HCELL (e.g., for targeting of inflammation and inflammatory disorders, bone marrow), Alpha4beta7 (e.g., for intestinal mucosa targeting), VLA-4/VCAM-I (e.g., targeting to endothelium). In general, any receptor involved in targeting (e.g., cancer metastasis) can be used as an extracellular domain of a chimeric polypeptide of the present disclosure.

In some cases, the antigen-binding domain is specific for a cancer antigen, i.e., an antigen expressed by (synthesized by) a neoplasia or cancer cell, i.e., a cancer cell associated antigen or a cancer (or tumor) specific antigen.

A cancer cell associated antigen can be an antigen associated with, e.g., a breast cancer cell, a B cell lymphoma, a pancreatic cancer, a Hodgkin lymphoma cell, an ovarian cancer cell, a prostate cancer cell, a mesothelioma, a lung cancer cell (e.g., a small cell lung cancer cell), a non-Hodgkin B-cell lymphoma (B-NHL) cell, an ovarian cancer cell, a prostate cancer cell, a mesothelioma, a lung cancer cell (e.g., a small cell lung cancer cell), a melanoma cell, a chronic lymphocytic leukemia cell, an acute lymphocytic leukemia cell, a neuroblastoma cell, a glioma, a glioblastoma, a medulloblastoma, a colorectal cancer cell, etc. A cancer cell associated antigen may also be expressed by a non-cancerous cell.

A cancer cell specific antigen can be an antigen specific for cancer and/or a particular type of cancer or cancer cell including e.g., a breast cancer cell, a B cell lymphoma, a pancreatic cancer, a Hodgkin lymphoma cell, an ovarian cancer cell, a prostate cancer cell, a mesothelioma, a lung cancer cell (e.g., a small cell lung cancer cell), a non-Hodgkin B-cell lymphoma (B-NHL) cell, an ovarian cancer cell, a prostate cancer cell, a mesothelioma, a lung cancer cell (e.g., a small cell lung cancer cell), a melanoma cell, a chronic lymphocytic leukemia cell, an acute lymphocytic leukemia cell, a neuroblastoma cell, a glioma, a glioblastoma, a medulloblastoma, a colorectal cancer cell, etc. A cancer (or tumor) specific antigen is generally not expressed by non-cancerous cells (or non-tumor cells). In some instances, a cancer (or tumor) specific antigen may be minimally expressed by one or more non-cancerous cell types (or non-tumor cell types). By "minimally expressed" is meant that the level of expression, in terms of either the per-cell expression level or the number of cells expressing, minimally, insignificantly or undetectably results in binding of the specific binding member to non-cancerous cells expressing the antigen.

In some instances, a specific binding member of a chimeric polypeptide may specifically bind a target comprising a fragment of a protein (e.g., a peptide) in conjunction with a major histocompatibility complex (MHC) molecule. As MHC molecules present peptide fragments of both intracellularly expressed and extracellularly expressed proteins, specific binding members directed to MHC-peptide complexes allows for the targeting of intracellular antigens as well as extracellularly expressed antigens.

Intracellularly expressed target proteins (e.g., cytoplasmically expressed (i.e., cytoplasmic proteins), nuclearly expressed (i.e., nuclear proteins), etc.) may be referred to as intracellular antigens (e.g., cytoplasmic antigens, nuclear antigens, etc.). Accordingly, specific binding members of the subject disclosure may be specific for intracellular antigen fragments complexed with MHC, e.g., a peptide-MHC complex, also, in some instances, described as a human leukocyte antigen (HLA)-peptide complex. Specific binding members of chimeric polypeptides that bind antigens expressed in the context of peptide-MHC are further described in PCT Application No. US2017/048040; the disclosure of which is incorporated herein by reference in its entirety.

Exemplary protein targets to which a specific binding member targeting a peptide-MHC complex may be directed as well as exemplary peptides in the context of MHC for each protein target are provided in Table 1 below.

TABLE 1

| anti-peptide-MHC targets | | | |
|---|---|---|---|
| Target | Exemplary Peptides | HLA | References |
| WT1 | RMFPNAPYL (SEQ ID NO: 170) | HLA-A2 | Leukemia. (2015) 29(11): 2238-47 |
| KRAS and KRAS mutants (e.g., G12V & G12C) | KLVVVGAGGV (SEQ ID NO: 171); KLVVVGAVGV (SEQ ID NO: 172); KLVVVGACGV (SEQ ID NO: 173); KLVVVGADGV (SEQ ID NO: 174); VVGAVGVGK (SEQ ID NO: 175); VVGACGVGK (SEQ ID NO: 176); VVGAGGVGK (SEQ ID NO: 177) | HLA-A2; HLA-A3 | Proc Natl Acad Sci USA. (2015) 112(32) |

TABLE 1-continued anti-peptide-MHC targets

| Target | Exemplary Peptides | HLA | References |
|---|---|---|---|
| EGFP and EGFP mutants (e.g., L858R) | KITDFGLAK (SEQ ID NO: 178); KITDFGRAK (SEQ ID NO: 179); | HLA-A3 | Proc Natl Acad Sci USA. (2015) 112(32) |
| PR1/Proteinase 3 | VLQELNVTV (SEQ ID NO: 180) | HLA-A2 | Cytotherapy. (2016) 18(8): 985-94 |
| MAGE-A1 | EADPTGHSY (SEQ ID NO: 181) | HLA-A1 | Blood. (2011) 117(16): 4262-4272 |
| MAGE3 | FLWGPRALV (SEQ ID NO: 182) | HLA-A2 | Eur J Immunol (2005) 35: 2864-2875 |
| P53 | LLGRNSFEV (SEQ ID NO: 183); STTPPPGTRV (SEQ ID NO: 184) RMPEAAPPV (SEQ ID NO: 185) GLAPPQHLIRV (SEQ ID NO: 186) | HLA-A2 | Gene Ther. (2001) 8(21): 1601-8 PLoS One (2017) 12: 1-16 |
| MART-1 | ELAGIGILTV (SEQ ID NO: 187) EAAGIGILTV (SEQ ID NO: 188) | HLA-A2 | Biomark Med. (2010) 4(4): 496-7 Eur J Immunol (2007) 37: 2008-2017 |
| gp100 | IMDQVPFSV (SEQ ID NO: 189) KTWGQYWQV (SEQ ID NO: 190) YLEPGPVTV (SEQ ID NO: 191) YLEPGPVTA (SEQ ID NO: 192) ITDQVPFSV (SEQ ID NO: 193) | HLA-A2 | Biomark Med. (2010) 4(4): 496-7 J Immunol (2002) 169: 4399-407 U.S. Patent Pub. No. US20030223994 J Immunol (2003) 171: 2197-2207 |
| CMV pp65 | NLVPMVATV (SEQ ID NO: 194) | HLA-A2 | Biomark Med. (2010) 4(4): 496-7 |
| HIV Vpr | AIIRILQQL (SEQ ID NO: 195) | HLA-A2 | Biomark Med. (2010) 4(4): 496-7 |
| HA-1H | VLHDDLLEA (SEQ ID NO: 196); VLRDDLLEA (SEQ ID NO: 197) | HLA-A2 | Biomark Med. (2010) 4(4): 496-7 |
| NY-ESO-1 | SLLMWITQV (SEQ ID NO: 198) | HLA-A2 | Gene Ther. (2014) 21(6): 575-84 |
| EBNA3C | LLDFVRFMGV (SEQ ID NO: 199) | HLA-A2 | Proc Natl Acad Sci USA. (2009) 106(14): 5784-8 |
| AFP | FMNKFIYEI (SEQ ID NO: 200) | HLA-A2 | Cancer Gene Ther. (2012) 19(2): 84-100 |
| Her2 | KIFGSLAFL (SEQ ID NO: 201) | HLA-A2 | Clin Cancer Res. (2016) pii: clincanres 1203.2016 |
| hCG-beta | GVLPALPQV (SEQ ID NO: 202) TMTRVLQGV (SEQ ID NO: 203) | HLA-A2 | J Natl Cancer Inst. (2013) 105(3): 202-18 Vaccine (2008) 26: 3092-3102 |
| HBV Env183-91 | FLLTRILTI (SEQ ID NO: 204) | HLA-A2 | J Immunol. (2006) 177(6): 4187-95 |
| hTERT | ILAKFLHWL (SEQ ID NO: 205) RLVDDFLLV (SEQ ID NO: 206) | HLA-A2 | Cancer Res (2002) 62: 3184-3194 |
| MUC1 | LLLTVLTVV (SEQ ID NO: 207) | HLA-A2 | Cancer Res (2002) 62: 5835-5844 |
| TARP | FLRNFSLML (SEQ ID NO: 208) | HLA-A2 | Eur J Immunol (2008) 38: 1706-1720 |
| Tyrosinase | YMDGTMSQV (SEQ ID NO: 209) | HLA-A2 | J Immunol (2009) 182: 6328-41 |
| p68 | YLLPAIVHI (SEQ ID NO: 210) | HLA-A2 | Cancer Immunol Immunother (2010) 59: 563-573 |
| MIF | FLSELTQQL (SEQ ID NO: 211) | HLA-A2 | J Immunol (2011) 186: 6607 |
| PRAME | ALYVDSLFFL (SEQ ID NO: 212) | HLA-A2 | J Clin Invest (2017) 1-14 |

In some instances, the specific binding member of a chimeric polypeptide of the instant disclosure specifically binds a peptide-MHC having an intracellular cancer antigen peptide of Table 1. In some instances, the specific binding member of a chimeric polypeptide of the instant disclosure is an antibody (e.g., a scFv) that specifically binds a peptide-MHC having an intracellular cancer antigen peptide of Table 1.

Chimeric polypeptides of the instant disclosure may, in some cases, target a surface expressed antigen. As used herein the term "surface expressed antigen" generally refers to antigenic proteins that are expressed at least partially extracellularly such that at least a portion of the protein is exposed outside the cells and available for binding with a binding partner. Essentially any surface expressed protein may find use as a target of a chimeric polypeptide of the instant disclosure. Non-limiting examples of surface expressed antigens include but are not limited to e.g., CD19, CD20, CD30, CD38, Her2/neu, ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), IL-13R-a2, GD2, and the like. Surface expressed antigens that may be targeted also include but are not limited to e.g., those specifically targeted in conventional cancer therapies, including e.g., those targets of the targeted cancer therapeutics described herein.

In some instances, the specific binding member of a chimeric polypeptide of the instant disclosure may target a cancer-associated antigen. In some instances, a specific binding member of the instant disclosure may include an antibody specific for a cancer associated antigen. Non-limiting examples of cancer associated antigens include but are not limited to e.g., CD19, CD20, CD38, CD30, Her2/neu, ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, and the like. Cancer-associated antigens also include, e.g., 4-1BB, 5T4, adenocarcinoma antigen, alpha-fetoprotein, BAFF, B-lymphoma cell, C242 antigen, CA-125, carbonic anhydrase 9 (CA-IX), C-MET, CCR4, CD152, CD19, CD20, CD200, CD22, CD221, CD23 (IgE receptor), CD28, CD30 (TNFRSF8), CD33, CD4, CD40, CD44 v6, CD51, CD52, CD56, CD74, CD80, CEA, CNT0888, CTLA-4, DR5, EGFR, EpCAM, CD3, FAP, fibronectin extra domain-B, folate receptor 1, GD2, GD3 ganglioside, glycoprotein 75, GPNMB, HER2/neu, HGF, human scatter factor receptor kinase, IGF-1 receptor, IGF-I, IgG1, L1-CAM, IL-13, IL-6, insulin-like growth factor I receptor, integrin α5β1, integrin αvβ3, MORAb-009, MS4A1, MUC1, mucin CanAg, N-glycolylneuraminic acid, NPC-1C, PDGF-R α, PDL192, phosphatidylserine, prostatic carcinoma cells, RANKL, RON, ROR1, SCH 900105, SDC1, SLAMF7, TAG-72, tenascin C, TGF beta 2, TGF-β, TRAIL-R1, TRAIL-R2, tumor antigen CTAA16.88, VEGF-A, VEGFR-1, VEGFR2, and vimentin.

In some instances, the specific binding member of a chimeric polypeptide of the instant disclosure may target or may include all or a portion of an antibody targeting phosphatase of regenerating liver 3 (PRL-3, also known as PTP4A3), such as e.g., PRL3-zumab as described in Thura et al. (JCI Insight. 2016; 1(9):e87607); the disclosure of which is incorporated herein by reference in its entirety.

In some instances, the extracellular domain of a chimeric polypeptide may include only one specific binding member. In some instances, the extracellular domain of a chimeric polypeptide may be mono-specific.

In some instances, the extracellular domain of a chimeric polypeptide may by multi-specific, including e.g., bispecific. In some instances, a bispecific extracellular domain of a chimeric polypeptide may include a bispecific chimeric binding member, or portion thereof, including e.g., those described herein, including but not limited to e.g., a bispecific antibody. In some instances, a bispecific extracellular domain may include two specific binding domains that are linked, including e.g., directly linked to each other or linked via a linker.

In some instances, the extracellular domain of a chimeric polypeptide may include more than one specific binding member, including two or more specific binding members where the two or more specific binding members may be linked (either directly or indirectly, e.g., through the use of a linker) to each other or they may each be linked (either directly or indirectly, e.g., through the use of a linker) to another component of the chimeric polypeptide.

Multi-specific extracellular domains may recognize or bind to any combination of binding partners and thus may target any combination of targets, including but not limited to e.g., those binding partners and targets described herein. Accordingly, e.g., a bispecific extracellular domain may target two different antigens including but not limited to e.g., two different intracellular antigens, two different extracellular (e.g., surface expressed) antigens or an intracellular antigen and an extracellular (e.g., surface expressed) antigen. In some instances, a bispecific extracellular domain may include two specific binding members, including e.g., two specific binding members described herein, that each bind an antigen, including e.g., an antigen described herein.

The specific binding domains of a multi-specific extracellular domain may each activate the chimeric polypeptide of which they are a part. The specific binding domains of a bispecific extracellular domain may each activate the chimeric polypeptide of which they are a part. In some instances, multi-specific or bispecific binding domains may find use as part of a molecular circuit as described herein including e.g., as an OR-gate of a circuit described herein.

In some instances, the binding partner bound by a specific binding domain may be mutated as compared to the wild-type binding partner. In some instances, a specific binding domain that recognizes a mutated binding partner may not specifically bind the wild-type binding partner. In some instances, a specific binding domain that recognizes a mutated binding partner may bind the wild-type binding partner with lower affinity as compared to its binding affinity with the mutated binding partner.

Any binding partner, including e.g., those described herein, may be mutated or may be a mutated binding partner. Accordingly, a chimeric polypeptide of the instant disclosure may include a specific binding member that specifically binds a mutated (i.e., non-wild-type) binding partner. Non-limiting examples of mutated binding partners include but are not limited to e.g., mutated antigens, mutated cancer antigens, mutated auto-antigens, mutated extracellular antigens, mutated extracellular cancer antigens, mutated extracellular auto-antigens, mutated surface antigens, mutated surface cancer antigens, mutated surface auto-antigens, peptide-MHC complexes presenting a mutated antigen peptide, peptide-MHC complexes presenting a mutated cancer antigen peptide, peptide-MHC complexes presenting a mutated auto-antigen peptide, and the like.

Cancers commonly involve mutated proteins that are associated with the disease. Genes commonly mutated in cancers include e.g., ABI1, ABL1, ABL2, ACKR3, ACSL3, ACSL6, AFF1, AFF3, AFF4, AKAP9, AKT1, AKT2, ALDH2, ALK, AMER1, APC, ARHGAP26, ARHGEF12, ARID1A, ARID2, ARNT, ASPSCR1, ASXL1, ATF1, ATIC, ATM, ATP1A1, ATP2B3, ATRX, AXIN1, BAP1, BCL10, BCL11A, BCL11B, BCL2, BCL3, BCL6, BCL7A, BCL9, BCOR, BCR, BIRC3, BLM, BMPR1A, BRAF, BRCA1, BRCA2, BRD3, BRD4, BRIP1, BTG1, BUB1B, C15orf65, C2orf44, CACNA1D, CALR, CAMTA1, CANT1, CARD11, CARS, CASC5, CASP8, CBFA2T3, CBFB, CBL, CBLB, CBLC, CCDC6, CCNB1IP1, CCND1, CCND2, CCND3, CCNE1, CD274, CD74, CD79A, CD79B, CDC73, CDH1, CDH11, CDK12, CDK4, CDK6, CDKN2A, CDKN2C, CDX2, CEBPA, CEP89, CHCHD7, CHEK2, CHIC2, CHN1, CIC, CIITA, CLIP1, CLP1, CLTC, CLTCL1, CNBP, CNOT3, CNTRL, COL1A1, COL2A1, COX6C, CREB1, CREB3L1, CREB3L2, CREBBP, CRLF2, CRTC1, CRTC3, CSF3R, CTNNB1, CUX1, CYLD, DAXX, DCTN1, DDB2, DDIT3, DDX10, DDX5, DDX6, DEK, DICER1, DNM2, DNMT3A, EBF1, ECT2L, EGFR, EIF3E, EIF4A2, ELF4, ELK4, ELL, ELN, EML4, EP300, EPS15, ERBB2, ERCT, ERCC2, ERCC3, ERCC4, ERCC5, ERG, ETV1, ETV4, ETV5, ETV6, EWSR1, EXT1, EXT2, EZH2, EZR, FAM46C, FANCA, FANCC, FANCD2, FANCE, FANCF, FANCG, FAS, FBXO11, FBXW7, FCGR2B, FCRL4, FEV, FGFR1, FGFR1OP, FGFR2, FGFR3, FH, FHIT, FIP1L1, FLCN, FLI1, FLT3, FNBP1, FOXA1, FOXL2, FOXO1, FOXO3, FOXO4, FOXP1, FSTL3, FUBP1, FUS, GAS7, GATA1, GATA2, GATA3, GMPS, GNA11, GNAQ, GNAS, GOLGA5, GOPC, GPC3, GPHN, H3F3A, H3F3B, HERPUD1, HEY1, HIP1, HIST1H4I, HLA-A, HLF, HMGA1, HMGA2, HNF1A, HNRNPA2B1, HOOK3, HOXA11, HOXA13, HOXA9, HOXC11, HOXC13, HOXD11, HOXD13, HRAS, HSP90AA1, HSP90AB1, IDH1, IDH2, IKZF1, IL2, IL21R, IL6ST, IL7R, IRF4, ITK, JAK1, JAK2, JAK3, JAZF1, JUN, KAT6A, KAT6B, KCNJ5, KDM5A, KDM5C, KDM6A, KDR, KDSR, KIAA1549, KIAA1598, KIF5B, KIT, KLF4, KLF6, KLK2, KMT2A, KMT2C, KMT2D, KRAS, KTN1, LASP1, LCK, LCP1, LHFP, LIFR, LMNA, LMO1, LMO2, LPP, LRIG3, LSM14A, LYL1, MAF, MAFB, MALT1, MAML2, MAP2K1, MAP2K2, MAP2K4, MAX, MDM2, MDM4, MECOM, MED12, MEN1, MET, MITF, MKL1, MLF1, MLH1, MLLT1, MLLT10, MLLT11, MLLT3, MLLT4, MLLT6, MN1, MNX1, MPL, MSH2, MSH6, MSI2, MSN, MTCP1, MUC1, MUTYH, MYB, MYC, MYCL, MYCN, MYD88, MYH11, MYH9, MYO5A, NAB2, NACA, NBN, NCKIPSD, NCOA1, NCOA2, NCOA4, NDRG1, NF1, NF2, NFATC2, NFE2L2, NFIB, NFKB2, NIN, NKX2-1, NONO, NOTCH1, NOTCH2, NPM1, NR4A3, NRAS, NRG1, NSD1, NT5C2, NTRK1, NTRK3, NUMA1, NUP214, NUP98, NUTM1, NUTM2A, NUTM2B, OLIG2, OMD, P2RY8, PAFAH1B2, PALB2, PATZ1, PAX3, PAX5, PAX7, PAX8, PBRM1, PBX1, PCM1, PCSK7, PDCD1LG2, PDE4DIP, PDGFB, PDGFRA, PDGFRB, PERI, PHF6, PHOX2B, PICALM, PIK3CA, PIK3R1, PIM1, PLAG1, PLCG1, PML, PMS1, PMS2, POT1, POU2AF1, POU5F1, PPARG, PPFIBP1, PPP2R1A, PRCC, PRDM1, PRDM16, PRF1, PRKAR1A, PRRX1, PSIP1, PTCH1, PTEN, PTPN11, PTPRB, PTPRC, PTPRK, PWWP2A, RABEP1, RAC1, RAD21, RAD51B, RAFT, RALGDS, RANBP17, RAP1GDS1, RARA, RB1, RBM15, RECQL4, REL, RET, RHOH, RMI2, RNF213, RNF43, ROS1, RPL10, RPL22, RPL5, RPN1, RSPO2, RSPO3, RUNX1, RUNX1T1, SBDS, SDC4, SDHAF2, SDHB, SDHC, SDHD, SEPT5, SEPT6, SEPT9, SET, SETBP1, SETD2, SF3B1, SFPQ, SH2B3, SH3GL1, SLC34A2, SLC45A3, SMAD4, SMARCA4, SMARCB1, SMARCE1, SMO, SOCS1, SOX2, SPECC1, SRGAP3, SRSF2, SRSF3, SS18, SS18L1, SSX1, SSX2, SSX2B, SSX4, SSX4B, STAG2, STAT3, STAT5B, STATE, STIL, STK11, SUFU, SUZ12, SYK, TAF15, TAL1, TAL2, TBL1XR1, TCEA1, TCF12, TCF3, TCF7L2, TCL1A, TERT, TET1, TET2, TFE3, TFEB, TFG, TFPT, TFRC, THRAP3, TLX1, TLX3, TMPRSS2, TNFAIP3, TNFRSF14, TNFRSF17, TOP1, TP53, TPM3, TPM4, TPR, TRAF7, TRIM24, TRIM27, TRIM33, TRIP11, TRRAP, TSC1, TSC2, TSHR, TTL, U2AF1, UBR5, USP6, VHL, VTI1A, WAS, WHSC1, WHSC1L1, WIF1, WRN, WT1, WWTR1, XPA, XPC, XPO1, YWHAE, ZBTB16, ZCCHC8, ZMYM2, ZNF331, ZNF384, ZNF521 and ZRSR2. In some instances, a specific binding member binds to the mutated version of a gene that is commonly mutated in cancer, including but not limited to e.g., those listed above. In some instances, a specific binding member binds to a peptide-MHC complex presenting a mutated cancer antigen peptide derived from the mutated version of a gene that is commonly mutated in cancer, including but not limited to e.g., those listed above. In some instances, a specific binding member binds to a peptide-MHC complex presenting a mutant KRAS peptide.

In some instances, a binding partner/specific binding member pair may be orthogonalized. As used herein, by "orthogonalized" is meant modified from their original or wild-type form such that the orthogonal pair specifically bind one another but do not specifically or substantially bind the non-modified or wild-type components of the pair. Any binding partner/specific binding pair may be orthogonalized, including but not limited to e.g., those binding partner/specific binding pairs described herein.

Certain extracellular domains and components thereof that may be adapted for use in chimeric polypeptides and the methods and circuits described herein include but are not limited to e.g., those described in PCT Application No. US2016/019188 (Pub. No. WO 2016/138034), the disclosure of which is incorporated herein by reference in its entirety.

Non-Antibody-Based Recognition Scaffolds

In some cases, the first member of the specific binding pair is a non-antibody-based recognition scaffold. Where the member of a specific binding pair in a chimeric polypeptide of the present disclosure is a non-antibody-based recognition scaffold, the chimeric polypeptide can be activated in the presence of a second member of the specific binding pair, where the second member of the specific binding pair is a target that binds to the non-antibody-based recognition scaffold.

Non-antibody-based recognition scaffolds include, e.g., an affibodies; engineered Kunitz domains; monobodies (adnectins); anticalins; designed ankyrin repeat domains (DARPins); a binding site of a cysteine-rich polypeptide (e.g., cysteine-rich knottin peptides); avimers; afflins; and the like. See, e.g., Gebauer and Skerra (2009) Curr. Opin. Chem. Biol. 13:245.

Non-antibody-based scaffolds (also referred to herein as "antibody mimic molecules") may be identified by selection or isolation of a target-binding variant from a library of binding molecules having artificially diversified binding sites. Diversified libraries can be generated using completely random approaches (e.g., error-prone polymerase chain reaction (PCR), exon shuffling, or directed evolution) or aided by art-recognized design strategies. For example, amino acid positions that are usually involved when the binding site interacts with its cognate target molecule can be randomized by insertion of degenerate codons, trinucleotides, random peptides, or entire loops at corresponding positions within the nucleic acid which encodes the binding site (see e.g., U.S. Pub. No. 20040132028). The location of the amino acid positions can be identified by investigation of the crystal structure of the binding site in protein entity with the target molecule. Candidate positions for randomization include loops, flat surfaces, helices, and binding cavities of the binding site. In certain embodiments, amino acids within the binding site that are likely candidates for diversification can be identified by their homology with the immunoglobulin fold. For example, residues within the CDR-like loops of fibronectin may be randomized to generate a library of fibronectin binding molecules (see, e.g., Koide et al., J. Mol. Biol., 284: 1141-1151 (1998)). Other portions of the binding site which may be randomized include flat surfaces. Following randomization, the diversified library may then be subjected to a selection or screening procedure to obtain binding molecules with the desired binding characteristics. For example, selection can be achieved by art-recognized methods such as phage display, yeast display, or ribosome display.

For example, in some cases, the non-antibody-based scaffold comprises a binding site from a fibronectin binding molecule. Fibronectin binding molecules (e.g., molecules comprising the Fibronectin type I, II, or III domains) display CDR-like loops which, in contrast to immunoglobulins, do not rely on intra-chain disulfide bonds. The FnIII loops comprise regions that may be subjected to random mutation and directed evolutionary schemes of iterative rounds of target binding, selection, and further mutation in order to develop useful therapeutic tools. Fibronectin-based "addressable" therapeutic binding molecules ("FATBIM") can be developed to specifically bind the target antigen or epitope. Methods for making fibronectin binding polypeptides are described, for example, in WO 01/64942 and in U.S. Pat. Nos. 6,673,901, 6,703,199, 7,078,490, and 7,119,171.

As another example, in some cases, the non-antibody-based scaffold comprises a binding site from an affibody. Affibodies are derived from the immunoglobulin binding domains of staphylococcal Protein A (SPA) (see e.g., Nord et al., Nat. Biotechnol., 15: 772-777 (1997)). An affibody is an antibody mimic that has unique binding sites that bind specific targets. Affibodies can be small (e.g., consisting of three alpha helices with 58 amino acids and having a molar mass of about 6 kDa), have an inert format (no Fc function), and have been successfully tested in humans as targeting moieties. Affibody binding sites can be synthesized by mutagenizing an SPA-related protein (e.g., Protein Z) derived from a domain of SPA (e.g., domain B) and selecting for mutant SPA-related polypeptides having binding affinity for a target antigen or epitope. Other methods for making affibody binding sites are described in U.S. Pat. Nos. 6,740,734 and 6,602,977 and in WO 00/63243.

As another example, in some cases, the non-antibody-based scaffold comprises a binding site from an anticalin. An anticalin is an antibody functional mimetic derived from a human lipocalin. Lipocalins are a family of naturally-occurring binding proteins that bind and transport small hydrophobic molecules such as steroids, bilins, retinoids, and lipids. The main structure of an anticalin is similar to wild type lipocalins. The central element of this protein architecture is a beta-barrel structure of eight antiparallel strands, which supports four loops at its open end. These loops form the natural binding site of the lipocalins and can be reshaped in vitro by extensive amino acid replacement, thus creating novel binding specificities. Anticalins possess high affinity and specificity for their ligands as well as fast binding kinetics, so that their functional properties are similar to those of antibodies. Anticalins are described in, e.g., U.S. Pat. No. 7,723,476.

As another example, in some cases, the non-antibody-based scaffold comprises a binding site from a cysteine-rich polypeptide. Cysteine-rich domains in some cases do not form an alpha-helix, a beta-sheet, or a beta-barrel structure. In some cases, the disulfide bonds promote folding of the domain into a three-dimensional structure. In some cases, cysteine-rich domains have at least two disulfide bonds, e.g., at least three disulfide bonds. An exemplary cysteine-rich polypeptide is an A domain protein. A-domains (sometimes called "complement-type repeats") contain about 30-50 or 30-65 amino acids. In some cases, the domains comprise about 35-45 amino acids and in some cases about 40 amino acids. Within the 30-50 amino acids, there are about 6 cysteine residues. Of the six cysteines, disulfide bonds typically are found between the following cysteines: C1 and C3, C2 and C5, C4 and C6. The A domain constitutes a ligand binding moiety. The cysteine residues of the domain are disulfide linked to form a compact, stable, functionally independent moiety. Clusters of these repeats make up a ligand binding domain, and differential clustering can impart specificity with respect to the ligand binding. Exemplary proteins containing A-domains include, e.g., complement components (e.g., C6, C7, C8, C9, and Factor I), serine proteases (e.g., enteropeptidase, matriptase, and corin), transmembrane proteins (e.g., ST7, LRP3, LRP5 and LRP6) and endocytic receptors (e.g. Sortilin-related receptor, LDL-receptor, VLDLR, LRP1, LRP2, and ApoER2). Methods for making A-domain proteins of a desired binding specificity are disclosed, for example, in WO 02/088171 and WO 04/044011.

As another example, in some cases, the non-antibody-based scaffold comprises a binding site from a repeat protein. Repeat proteins are proteins that contain consecutive copies of small (e.g., about 20 to about 40 amino acid residues) structural units or repeats that stack together to form contiguous domains. Repeat proteins can be modified to suit a particular target binding site by adjusting the number of repeats in the protein. Exemplary repeat proteins include designed ankyrin repeat proteins (i.e., a DARPins) (see e.g., Binz et al., Nat. Biotechnol., 22: 575-582 (2004)) or leucine-rich repeat proteins (i.e., LRRPs) (see e.g., Pancer et al., Nature, 430: 174-180 (2004)). As another example, in some cases, the non-antibody-based scaffold comprises a DARPin.

As used herein, the term "DARPin" refers to a genetically engineered antibody mimetic protein that typically exhibits highly specific and high-affinity target protein binding. DARPins were first derived from natural ankyrin proteins. In some cases, DARPins comprise three, four or five repeat motifs of an ankyrin protein. In some cases, a unit of an ankyrin repeat consists of 30-34 amino acid residues and functions to mediate protein-protein interactions. In some cases, each ankyrin repeat exhibits a helix-turn-helix conformation, and strings of such tandem repeats are packed in a nearly linear array to form helix-turn-helix bundles connected by relatively flexible loops. In some cases, the global structure of an ankyrin repeat protein is stabilized by intra- and inter-repeat hydrophobic and hydrogen bonding interactions. The repetitive and elongated nature of the ankyrin repeats provides the molecular bases for the unique characteristics of ankyrin repeat proteins in protein stability, folding and unfolding, and binding specificity. The molecular mass of a DARPin domain can be from about 14 or 18 kDa for four- or five-repeat DARPins, respectively. DARPins are described in, e.g., U.S. Pat. No. 7,417,130. In some cases, tertiary structures of ankyrin repeat units share a characteristic composed of a beta-hairpin followed by two antiparallel alpha-helices and ending with a loop connecting the repeat unit with the next one. Domains built of ankyrin repeat units can be formed by stacking the repeat units to an extended and curved structure. LRRP binding sites from part of the adaptive immune system of sea lampreys and other jawless fishes and resemble antibodies in that they are formed by recombination of a suite of leucine-rich repeat genes during lymphocyte maturation. Methods for making DARpin or LRRP binding sites are described in WO 02/20565 and WO 06/083275.

As another example, in some cases, the non-antibody-based scaffold comprises a binding site derived from Src homology domains (e.g. SH2 or SH3 domains), PDZ domains, beta-lactamase, high affinity protease inhibitors, or small disulfide binding protein scaffolds such as scorpion toxins. Methods for making binding sites derived from these molecules have been disclosed in the art, see e.g., Panni et al., J. Biol. Chem., 277: 21666-21674 (2002), Schneider et al., Nat. Biotechnol., 17: 170-175 (1999); Legendre et al., Protein Sci., 11:1506-1518 (2002); Stoop et al., Nat. Biotechnol., 21: 1063-1068 (2003); and Vita et al., PNAS, 92: 6404-6408 (1995). Yet other binding sites may be derived from a binding domain selected from the group consisting of an EGF-like domain, a Kringle-domain, a PAN domain, a Gla domain, a SRCR domain, a Kunitz/Bovine pancreatic trypsin Inhibitor domain, a Kazal-type serine protease inhibitor domain, a Trefoil (P-type) domain, a von Willebrand factor type C domain, an Anaphylatoxin-like domain, a CUB domain, a thyroglobulin type I repeat, LDL-receptor class A domain, a Sushi domain, a Link domain, a Thrombospondin type I domain, an Immunoglobulin-like domain, a C-type lectin domain, a MAM domain, a von Willebrand factor type A domain, a Somatomedin B domain, a WAP-type four disulfide core domain, a F5/8 type C domain, a Hemopexin domain, a Laminin-type EGF-like domain, a C2 domain, a binding domain derived from tetranectin in its monomeric or trimeric form, and other such domains known to those of ordinary skill in the art, as well as derivatives and/or variants thereof. Exemplary non-antibody-based scaffolds, and methods of making the same, can also be found in Stemmer et al., "Protein scaffolds and uses thereof", U.S. Patent Publication No. 20060234299 (Oct. 19, 2006) and Hey, et al., Artificial, Non-Antibody Binding Proteins for Pharmaceutical and Industrial Applications, TRENDS in Biotechnology, vol. 23, No. 10, Table 2 and pp. 514-522 (October 2005).

As another example, in some cases, the non-antibody-based scaffold comprises a Kunitz domain. The term "Kunitz domains" as used herein, refers to conserved protein domains that inhibit certain proteases, e.g., serine proteases. Kunitz domains are relatively small, typically being about 50 to 60 amino acids long and having a molecular weight of about 6 kDa. Kunitz domains typically carry a basic charge and are characterized by the placement of two, four, six or eight or more that form disulfide linkages that contribute to the compact and stable nature of the folded peptide. For example, many Kunitz domains have six conserved cysteine residues that form three disulfide linkages. The disulfide-rich α/β fold of a Kunitz domain can include two, three (typically), or four or more disulfide bonds.

Kunitz domains have a pear-shaped structure that is stabilized the, e.g., three disulfide bonds, and that contains a reactive site region featuring the principal determinant P1 residue in a rigid confirmation. These inhibitors competitively prevent access of a target protein (e.g., a serine protease) for its physiologically relevant macromolecular substrate through insertion of the P1 residue into the active site cleft. The P1 residue in the proteinase-inhibitory loop provides the primary specificity determinant and dictates much of the inhibitory activity that particular Kunitz protein has toward a targeted proteinase. In general, the N-terminal side of the reactive site (P) is energetically more important that the P' C-terminal side. In most cases, lysine or arginine occupy the P1 position to inhibit proteinases that cleave adjacent to those residues in the protein substrate. Other residues, particularly in the inhibitor loop region, contribute to the strength of binding. Generally, about 10-12 amino acid residues in the target protein and 20-25 residues in the proteinase are in direct contact in the formation of a stable proteinase-inhibitor protein entity and provide a buried area of about 600 to 900 A. By modifying the residues in the P site and surrounding residues Kunitz domains can be designed to target a protein of choice. Kunitz domains are described in, e.g., U.S. Pat. No. 6,057,287.

As another example, in some cases, the non-antibody-based scaffold is an affilin Affilins are small antibody-mimic proteins which are designed for specific affinities towards proteins and small compounds. New affilins can be very quickly selected from two libraries, each of which is based on a different human derived scaffold protein. Affilins do not show any structural homology to immunoglobulin proteins. There are two commonly-used affilin scaffolds, one of which is gamma crystalline, a human structural eye lens protein and the other is "ubiquitin" superfamily proteins. Both human scaffolds are very small, show high temperature stability and are almost resistant to pH changes and denaturing agents. This high stability is mainly due to the expanded beta sheet structure of the proteins. Examples of gamma crystalline derived proteins are described in WO200104144 and examples of "ubiquitin-like" proteins are described in WO2004106368.

As another example, in some cases, the non-antibody-based scaffold is an Avimer. Avimers are evolved from a large family of human extracellular receptor domains by in vitro exon shuffling and phage display, generating multidomain proteins with binding and inhibitory properties Linking multiple independent binding domains has been shown to create avidity and results in improved affinity and specificity compared with conventional single-epitope binding proteins. In certain embodiments, Avimers consist of two or more peptide sequences of 30 to 35 amino acids each, connected by spacer region peptides. The individual sequences are derived from A domains of various membrane receptors and have a rigid structure, stabilized by disulfide bonds and calcium. Each A domain can bind to a certain epitope of the target protein. The combination of domains binding to different epitopes of the same protein increases affinity to this protein, an effect known as avidity (hence the name). Avimers with sub-nanomolar affinities have been obtained against a variety of targets. Alternatively, the domains can be directed against epitopes on different target proteins. Additional information regarding avimers can be found in U.S. patent application Publication Nos. 2006/0286603, 2006/0234299, 2006/0223114, 2006/0177831, 2006/0008844, 2005/0221384, 2005/0164301, 2005/0089932, 2005/0053973, 2005/0048512, 2004/0175756.

Suitable targets of a non-antibody-based scaffold include any of the above-mentioned antigens to which an antibody-based scaffold can bind.

In some cases, the target (second member of the specific binding pair) bound by the non-antibody-based scaffold is soluble. In some cases, the target is membrane-bound, e.g., in some cases, the target is present on the surface of a cell. In some cases, the target is immobilized on an insoluble support, where an insoluble support can comprise any of a variety of materials (e.g., polyethylene, polystyrene, polyvinylpyrrolidone, polycarbonate, nitrocellulose, and the like); and where an insoluble support can take a variety of forms, e.g., a plate, a tissue culture dish, a column, and the like. In some cases, the target is present in an extracellular matrix (ECM) (e.g., the antigen is an ECM component). In some cases, the target is present in an artificial matrix. In some cases, the target is present in an acellular environment.

Cell Adhesion Molecules

In some cases, the first member of the specific binding pair is a cell adhesion molecule (CAM), i.e., a polypeptide that binds a component of an extracellular matrix (ECM) or that binds a cell surface molecule. For example, in some cases, the first member of the specific binding pair is the extracellular region of a CAM. In some cases, the CAM is a calcium-independent adhesion molecule; for example, in some cases, the CAM is an immunoglobulin superfamily CAM. In some cases, the CAM is a calcium-dependent adhesion molecule; e.g., the CAM is an integrin, a cadherin, or a selectin. In some cases, the first member of the specific binding pair is an integrin. In some cases, the first member of the specific binding pair is a cadherin, e.g., an E-cadherin, a P-cadherin, an N-cadherin, an R-cadherin, an M-cadherin, etc. In some cases, the first member of the specific binding pair is a selectin, e.g., an E-selectin, an L-selectin, or a P-selectin. Binding fragments of a CAM can be used as the first member of the specific binding pair.

Where the first member of the specific binding pair is a CAM, the second member of the specific binding pair is a component of ECM or a cell surface molecule that binds the CAM. For example, where the first member of the specific binding pair is an integrin, the second member of the specific binding pair is a component of collagen, fibrinogen, fibronectin, or vitronectin. As another example, where the first member of the specific binding pair is cadherin, the second member of the specific binding pair is cell surface antigen bound by the cadherin. As another example, where the first member of the specific binding pair is a selectin, the second member of the specific binding pair is a fucosylated carbohydrate.

Ligands

In some cases, the first member of the specific binding pair is a ligand for a receptor. Ligands include polypeptides, nucleic acids, glycoproteins, small molecules, carbohydrates, lipids, glycolipids, lipoproteins, lipopolysaccharides, etc. In some cases, the ligand is soluble.

Ligands include, but are not limited to, cytokines (e.g., IL-13, etc.); growth factors (e.g., heregulin; vascular endothelial growth factor (VEGF); and the like); peptide hormones; an integrin-binding peptide (e.g., a peptide comprising the sequence Arg-Gly-Asp); an N-glycan; follicle stimulating hormone (FSH); and the like.

Where the member of a specific binding pair in a chimeric polypeptide of the present disclosure is a ligand, the chimeric polypeptide can be activated in the presence of a second member of the specific binding pair, where the second member of the specific binding pair is a receptor for the ligand. For example, where the ligand is FSH, the second member of the specific binding pair can be a FSH receptor. Alternatively, the first member of the specific binding pair can be a FSH receptor (FSHR); and the first member of the specific binding pair can be FSH. As another example, where the ligand is heregulin, the second member of the specific binding pair can be Her2.

Where the first member of the specific binding pair is a ligand, the second member of the specific binding pair is a molecule that binds the ligand, e.g., the second member of the specific binding pair is an antibody that specifically binds the ligand, a receptor for the ligand, etc.

Where the first member of the specific binding pair is a ligand, in some cases, the second member of the specific binding pair (the molecule that binds the ligand) is soluble. In some cases, the second member of the specific binding pair is membrane-bound, e.g., in some cases, the second member of the specific binding pair is present on the surface of a cell. In some cases, the second member of the specific binding pair is immobilized on an insoluble support, where an insoluble support can comprise any of a variety of materials (e.g., polyethylene, polystyrene, polyvinylpyrrolidone, polycarbonate, nitrocellulose, and the like); and where an insoluble support can take a variety of forms, e.g., a plate, a tissue culture dish, a column, and the like. In some cases, the second member of the specific binding pair is present in an acellular environment.

Antigens

In some cases, the first member of the specific binding pair is an antigen to which an antibody specifically binds. The antigen can be any antigen, e.g., a naturally-occurring (endogenous) antigen; a synthetic (e.g., modified in such a way that it is no longer the same as a naturally-occurring antigen; modified from its natural state; etc.) antigen; etc.

Where the member of a specific binding pair in a chimeric polypeptide of the present disclosure is an antigen, the chimeric polypeptide can be activated in the presence of a second member of the specific binding pair, where the second member of the specific binding pair is an antibody (antibody-based recognition scaffold) that binds to the antigen.

In some cases, the antigen is a disease-associated antigen, e.g., a cancer-associated antigen, an autoimmune disease-associated antigen, a pathogen-associated antigen, an inflammation-associated antigen, or the like.

For example, where the second member of the specific binding pair is an antibody specific for a cancer-associated antigen, the antigen can be a cancer-associated antigen, where cancer-associated antigens include, e.g., CD19, CD20, CD38, CD30, Her2/neu, ERBB2, CA125, MUC-1, prostate-specific membrane antigen (PSMA), CD44 surface adhesion molecule, mesothelin, carcinoembryonic antigen (CEA), epidermal growth factor receptor (EGFR), EGFRvIII, vascular endothelial growth factor receptor-2 (VEGFR2), high molecular weight-melanoma associated antigen (HMW-MAA), MAGE-A1, IL-13R-a2, GD2, and the like. Cancer-associated antigens also include, e.g., 4-1BB, 5T4, adenocarcinoma antigen, alpha-fetoprotein, BAFF, B-lymphoma cell, C242 antigen, CA-125, carbonic anhydrase 9 (CA-IX), C-MET, CCR4, CD152, CD19, CD20, CD200, CD22, CD221, CD23 (IgE receptor), CD28, CD30 (TNFRSF8), CD33, CD4, CD40, CD44 v6, CD51, CD52, CD56, CD74, CD80, CEA, CNTO888, CTLA-4, DR5, EGFR, EpCAM, CD3, FAP, fibronectin extra domain-B, folate receptor 1, GD2, GD3 ganglioside, glycoprotein 75, GPNMB, HER2/neu, HGF, human scatter factor receptor kinase, IGF-1 receptor, IGF-I, IgG1, L1-CAM, IL-13, IL-6, insulin-like growth factor I receptor, integrin $\alpha5\beta1$, integrin $\alpha v\beta3$, MORAb-009, MS4A1, MUC1, mucin CanAg, N-glycolylneuraminic acid, NPC-1C, PDGF-R $\alpha$, PDL192, phosphatidylserine, prostatic carcinoma cells, RANKL, RON, ROR1, SCH 900105, SDC1, SLAMF7, TAG-72, tenascin C, TGF beta 2, TGF-$\beta$, TRAIL-R1, TRAIL-R2, tumor antigen CTAA16.88, VEGF-A, VEGFR-1, VEGFR2, and vimentin.

The antigen can be associated with an inflammatory disease. Non-limiting examples of antigens associated with inflammatory disease include, e.g., AOC3 (VAP-1), CAM-3001, CCL11 (eotaxin-1), CD125, CD147 (basigin), CD154

(CD40L), CD2, CD20, CD23 (IgE receptor), CD25 (a chain of IL-2 receptor), CD3, CD4, CD5, IFN-α, IFN-γ, IgE, IgE Fc region, IL-1, IL-12, IL-23, IL-13, IL-17, IL-17A, IL-22, IL-4, IL-5, IL-5, IL-6, IL-6 receptor, integrin α4, integrin α4β7, LFA-1 (CD11a), myostatin, OX-40, scleroscin, SOST, TGF beta 1, TNF-α, and VEGF-A.

Where the first member of the specific binding pair is an antigen, the second member of the specific binding pair can be an antibody-based scaffold (e.g., an antibody) or a non-antibody-based scaffold. In some cases, the second member of the specific binding pair is present on the surface of a cell. In some cases, the second member of the specific binding pair is immobilized on an insoluble support. In some cases, the second member of the specific binding pair is soluble. In some cases, the second member of the specific binding pair is present in an extracellular environment (e.g., extracellular matrix). In some cases, the second member of the specific binding pair is present in an artificial matrix. In some cases, the second member of the specific binding pair is present in an acellular environment.

Targets of Non-Antibody-Based Recognition Scaffolds

In some cases, the first member of the specific binding pair is a target of a non-antibody-based scaffold. Targets include, e.g., polypeptides, nucleic acids, glycoproteins, small molecules, carbohydrates, lipids, glycolipids, lipoproteins, lipopolysaccharides, etc.

Where the first member of the specific binding pair is a target of a non-antibody-based scaffold, the second member of the specific binding pair is a non-antibody-based scaffold.

Receptors

In some cases, the first member of the specific binding pair is a receptor. In some cases, the receptor is a growth factor receptor. In some cases, the receptor is a cytokine receptor. In some cases, the receptor is a cell surface receptor that binds to a co-receptor on a cell. In some cases, the receptor is a neurotransmitter receptor. In some cases, the receptor binds to an extracellular matrix component. In some cases, the receptor is an immunoglobulin Fc receptor.

Suitable receptors include, but are not limited to, a growth factor receptor (e.g., a VEGF receptor); a killer cell lectin-like receptor subfamily K, member 1 (NKG2D) polypeptide (receptor for MICA, MICB, and ULB6); a cytokine receptor (e.g., an IL-13 receptor; an IL-2 receptor; etc.); an epidermal growth factor (EGF) receptor; Her2; CD27; a natural cytotoxicity receptor (NCR) (e.g., NKP30 (NCR3/CD337) polypeptide (receptor for HLA-B-associated transcript 3 (BAT3) and B7-H6); etc.); a T cell antigen receptor; a dihydrofolate receptor; a chimeric cytokine receptor; an Fc receptor; an extracellular matrix receptor (e.g. an integrin); a cell adhesion receptor (e.g. a cadherin); an immunoregulatory receptor including both positive co-receptors (e.g. CD28) and negative (immunosuppressive) co-receptors (e.g., PD1); a cytokine receptor; FSH receptor, and a receptor for a immunoregulatory molecule (e.g. TGFβ), etc. In some cases, the receptor is truncated, relative to the wild-type receptor.

Where the first member of the specific binding pair is a receptor, the second member of the specific binding pair is target of the receptor, where the target can be a ligand for the receptor, or a co-receptor. In some cases, the second member of the specific binding pair is present on the surface of a cell. In some cases, the second member of the specific binding pair is immobilized on an insoluble support. In some cases, the second member of the specific binding pair is soluble. In some cases, the second member of the specific binding pair is present in an extracellular environment (e.g., extracellular matrix). In some cases, the second member of the specific binding pair is present in an artificial matrix. In some cases, the second member of the specific binding pair is present in an acellular environment.

Intracellular Domains

As noted above, a chimeric polypeptide of the present disclosure comprises an intracellular domain that is released following binding of the chimeric polypeptide to the binding partner of the extracellular specific binding member, where such binding induces cleavage of an above-mentioned proteolytic cleavage site present in a force sensor cleavage domain.

The intracellular domain may comprise a Notch intracellular domain. The intracellular domain may comprise an amino acid sequence that is heterologous to one or more Notch receptors (i.e., the subject domain is not derived from a Notch receptor). In other words, the intracellular domain may comprise an amino acid sequence that is not naturally present in a Notch receptor polypeptide.

In some instances, the intracellular domain, when released from the chimeric polypeptide, induces a transcriptional response in the cell or otherwise modulates transcription. For example, in some instances, the intracellular domain activates transcription within the cell and thus serves as a transcriptional activator and may contain a transcription activation domain Such transcriptional activators may vary and may, in some instances, include e.g., a DNA binding domain and one or more activator/activation domains.

The intracellular domain may provide essentially any effector function attributable to an expressed peptide or protein, wherein such effector functions may include but are not limited to, e.g., increased production of one or more cytokines by the cell; reduced production of one or more cytokines by the cell; increased or decreased production of a hormone by the cell; production of an antibody by the cell; a change in organelle activity; a change in trafficking of a polypeptide within the cell; a change in transcription of a target gene; a change in activity of a protein; a change in cell activity, e.g., cell death; cellular proliferation; effects on cellular differentiation; effects on cell survival; modulation of cellular signaling responses; etc. In some cases, the intracellular domain, when released from the chimeric polypeptide, provides for a change in transcription of a target gene. In some cases, the intracellular domain, when released from the chimeric polypeptide, provides for an increase in the transcription of a target gene. In some cases, the intracellular domain, when released from the chimeric polypeptide, provides for a decrease in expression of a target gene.

In some instances, the intracellular domain of a chimeric polypeptide of the instant disclosure includes a transcriptional activator. Any convenient transcriptional activator may find use in the intracellular domain of a chimeric polypeptide of the instant disclosure. Within a cell or system, a transcriptional activator may be paired with a transcriptional control element that is responsive to the transcriptional activator, e.g., to drive expression of a nucleic acid encoding a polypeptide of interest that is operably linked to the transcriptional control element. Useful transcriptional activators, transcriptional control elements, activator/control element pairs, and components of such systems may include but are not limited to e.g., those used in inducible expression systems including but not limited to e.g., those described in Goverdhana et al. Mol Ther. (2005) 12(2): 189-211; U.S. Patent Application Pub. Nos. 20160152701, 20150376627, 20130212722, 20070077642, 20050164237, 20050066376, 20040235169, 20040038249, 20030220286, 20030199022, 20020106720; the disclosures of which are incorporated herein by reference in their entirety.

In some instances, useful transcriptional activators may include mammalian transcription factors or engineered or mutated forms thereof. In some instances, useful transcriptional activators may include human transcription factors or engineered or mutated forms thereof. In some instances, useful transcriptional activators may include mouse transcription factors or engineered or mutated forms thereof. In some instances, useful transcriptional activators may include rat transcription factors or engineered or mutated forms thereof. In some instances, useful transcriptional activators may include cow transcription factors or engineered or mutated forms thereof. In some instances, useful transcriptional activators may include pig transcription factors or engineered or mutated forms thereof.

In some instances, use of a mammalian transcription factor may reduce the chance that the transcription factor induces an immune response in a mammal. In some instances, use of an engineered or mutated transcription factor, including e.g., mutated or engineered mammalian transcription factors, may reduce the chance that the transcription factor induces an immune response in a mammal Useful mammalian transcription factors include but are not limited to e.g., zinc finger (ZnF) proteins.

In some instances, the intracellular domain is a transcriptional activator. In some cases, the intracellular domain comprises an amino acid sequence having at least 75%, at least 80%, at least 85%, at least 90%, at least 95%, at least 98%, at least 99%, or 100%, amino acid sequence identity to the following tetracycline-controlled transcriptional activator (tTA) amino acid sequence: MSRLDKSKVIN-SALELLNEVGIEGLTTRKLAQKLGVEQPTLYWHVK-NKRALLDALAIEMLDRH HTHFCPLEGESWQDFLRN-NAKSFRCALLSHRDGAKVHLGTRPTEKQYETLEN-QLAFLCQQGFS LENALYALSAVGHFTLGCVLEDQE-HQVAKEERETPTTDSMPPLLRQAIELFDHQGAE-PAFLFGL ELIICGLEKQLKCESGGPADALDDFDLD-MLPADALDDFDLDMLPADALDDFDLDMLPG (SEQ ID NO:213); and has a length of from about 245 amino acids to 252 amino acids (e.g., 248, 249, 250, 251, or 252 amino acids).

In some embodiments, the intracellular domain comprises a transcriptional activator. In some cases, the transcriptional activator is GAL4-VP16. In some cases, the transcriptional activator is VP64 Zip(+). In some cases the transcriptional activator is an engineered protein, such as a zinc finger or TALE based DNA binding domain fused to an effector domain such as VP64. A variety of other transcriptional transactivators known in the art are suitable for use.

In some cases, the intracellular domain comprises an amino acid sequence having at least 75%, at least 80%, at least 85%, at least 90%, at least 95%, at least 98%, at least 99%, or 100%, amino acid sequence identity to the following GAL4-VP64 sequence: MKLLSSIEQACDI-CRLKKLKCSKEKPKCAKCLKNNWECRYSPKTKR-SPLTRAHLTEVESRLERL EQLFLLIFPREDLDMILK-MDSLQDIKALLTGLFVQDNVNKDAVTDRLASVETD-MPLTLRQHRIS ATSSSEESSNKGQRQLTVSAAAGG-SGGSGGSDALDDFDLDMLGSDALDDFDLDMLGS-DALDDF DLDMLGSDALDDFDLDMLGS (SEQ ID NO:214); and has a length of from 208 to 214 amino acids (e.g., 208, 209, 210, 211, 212, 213, or 214 amino acids).

In some cases, the intracellular domain comprises an amino acid sequence having at least 75%, at least 80%, at least 85%, at least 90%, at least 95%, at least 98%, at least 99%, or 100%, amino acid sequence identity to the following VP64 Zip(+) transcriptional activator sequence: PKKKRKVDALDDFDLDMLGSDALDDFDLDMLGS-DALDDFDLDMLGSDALDDFDLDMLGSGG SGGSG-GSLEIEAAFLERENTALETRVAELRQRVQRLRNR-VSQYRTRYGPLGGGK (SEQ ID NO:215); and has a length of from 105 to 115 amino acids (e.g., 105, 106, 107, 108, 109, 110, 111, 112, 113, 114 or 115 amino acids).

In some instances, the intracellular domain of a chimeric polypeptide of the present disclosure may include an enzyme of a portion thereof, e.g., the functional/catalytic domain of the enzyme. For example, in some instances an intracellular domain may include one or more enzyme domains including e.g., a domain from an oxidoreductase, a transferase, a hydrolase, a lyase, an isomerases, a ligase, etc. In some instances, an intracellular domain may include a domain derived from a nuclease (i.e., a nuclease domain), including but not limited to e.g., a site-specific nuclease domain, such as but not limited to e.g., a RNA guided nuclease (e.g., CRISPR/Cas9 site-specific nuclease and derivatives thereof (e.g., a nickase) domain, a non-Cas9 site-specific nuclease (e.g., a zinc-finger nuclease (ZFN), a TAL effector nucleases (TALEN), etc.) domain or the like. Also of use may be a Cas9 variant that lacks nuclease activity such as "dead Cas9" or "dCas9". Examples of domains that may be employed include those described in PCT Pub. No. WO 2016/138034; the disclosure of which is incorporated herein by reference in its entirety.

In some instances, the intracellular domain of a chimeric polypeptide of the instant disclosure, upon activation of the chimeric polypeptide, induces expression of a POI. A POI may be essentially any polypeptide and may include but is not limited to polypeptides of research interest (e.g., reporter polypeptides, mutated polypeptides, novel synthetic polypeptides, etc.), polypeptides of therapeutic interest (e.g., naturally occurring therapeutic proteins, recombinant therapeutic polypeptides, etc.), polypeptides of industrial interest (e.g., polypeptides used in industrial applications such as e.g., manufacturing), and the like.

In some instances, the intracellular domain of a chimeric polypeptide of the instant disclosure, upon activation of the chimeric polypeptide, induces expression of a regulatory nucleic acid (e.g., a regulatory RNA). As described in more detail below, regulatory nucleic acids will generally be non-coding nucleic acids that, when expressed, provide a direct regulatory (e.g., activating or inhibiting) function, e.g., increasing/decreasing the expression, translation or function of a protein, increasing/decreasing the expression, translation or function of a RNA encoding a protein, increasing/decreasing the expression, translation or function of another regulatory nucleic acid, etc.

As will be readily understood, in many instances where the subject methods and/or compositions describe employing a POI, a suitable regulatory nucleic acid may be substituted for the POI. As such, regulatory nucleic acids that may be expressed include but are not limited to e.g., regulatory nucleic acids of research interest (e.g., inhibitors of reporter polypeptides, mutated regulatory nucleic acids, novel synthetic regulatory nucleic acids, etc.), regulatory nucleic acids of therapeutic interest (e.g., regulatory nucleic acids that inhibit disease-related proteins, regulatory nucleic acids that increase the expression or activity of natural or recombinant therapeutic polypeptides, etc.), and the like.

In some instances, a POI may be a therapeutic polypeptide including but not limited to a therapeutic polypeptide for treating a neoplasia such as e.g., a tumor, a cancer, etc. In some instances, a therapeutic POI for treating a neoplasia may be a POI used in immunotherapy for cancer. In some instances, a therapeutic POI may be a CAR. In some instances, a therapeutic POI may be a TCR. In some instances, a therapeutic POI may be an antibody. In some instances, a therapeutic POI may be a chimeric bispecific binding member. In some instances, a therapeutic POI may be an innate-immune response inducer. In some instances, a therapeutic POI may be an immune suppression factor.

POIs of the instant disclosure include orthogonalized POIs. Orthogonalized POIs include those POIs that have been modified from their original or wild-type form such that the orthogonal POI specifically reacts with or binds a specific orthogonalized partner but does not specifically or substantially react with of bind the unmodified or wild-type partner. Any POI may be orthogonalized, including but not limited to e.g., those POIs described herein.

In some instances, a therapeutic POI may be an anti-Fc CAR. An anti-Fc CAR generally includes the extracellular domain of an Fc receptor, an intracellular signaling domain and optionally a co-stimulatory domain Depending on the therapeutic context, an anti-Fc CAR may include an extracellular domain of any Fc receptor including e.g., a Fc-gamma receptor (e.g., FcγRI (CD64), FcγRIIA (CD32), FcγRIIB (CD32), FcγRIIIA (CD16a), FcγRIIIB (CD16b)), a Fc-alpha receptor (e.g., FcαRI (CD89)) or a Fc-epsilon receptor (e.g., FcεRI, FcεRII (CD23)). For example, in some instances, an anti-Fc CAR may include the extracellular domain of the CD16 Fc receptor. In some instances, an anti-Fc CAR may include the extracellular domain of the CD16 Fc receptor, a CD3-zeta intracellular signaling domain and a 4-1BB co-stimulatory domain. In some instances, an anti-Fc CAR may be an Antibody-Coupled T-cell Receptor (ACTR), e.g., as available from (Unum Therapeutics Inc.; Cambridge, MA).

In some instances, one or more domains of the anti-Fc CAR may be a mutated domain including where the domain is mutated, e.g., to modulate affinity (e.g., increase affinity or decrease affinity) for a binding partner, to modulate intracellular signaling properties (e.g., increase signaling or decrease signaling), etc.

In some instances, a chimeric polypeptide of the present disclosure may be expressed on a cell such that, upon binding the specific binding partner of the chimeric polypeptide, the intracellular domain of the chimeric polypeptide induces transcription of an anti-Fc CAR from a nucleic acid sequence within the cell. In some instances, an antibody that binds the anti-Fc CAR and a tumor antigen may be administered to a subject also administered such a cell. In some instances, a chimeric polypeptide of the present disclosure may be expressed on a cell such that, upon binding the specific binding partner of the chimeric polypeptide, the intracellular domain of the chimeric polypeptide induces transcription of an anti-Fc CAR and an antibody that binds the anti-Fc CAR and a tumor antigen from one or more nucleic acid sequences within the cell.

In some instances, a therapeutic POI may be a chimeric bispecific binding member. As used herein, by "chimeric bispecific binding member" is meant a chimeric polypeptide having dual specificity to two different binding partners (e.g., two different antigens). Non-limiting examples of chimeric bispecific binding members include bispecific antibodies, bispecific conjugated monoclonal antibodies (mab)$_2$, bispecific antibody fragments (e.g., F(ab)$_2$, bispecific scFv, bispecific diabodies, single chain bispecific diabodies, etc.), bispecific T cell engagers (BiTE), bispecific conjugated single domain antibodies, micabodies and mutants thereof, and the like. Non-limiting examples of chimeric bispecific binding members also include those chimeric bispecific agents described in Kontermann *MAbs*. (2012) 4(2): 182-197; Stamova et al. *Antibodies* 2012, 1(2), 172-198; Farhadfar et al. *Leuk Res*. (2016) 49:13-21; Benjamin et al. *Ther Adv Hematol*. (2016) 7(3):142-56; Kiefer et al. *Immunol Rev*. (2016) 270(1):178-92; Fan et al. *J Hematol Oncol*. (2015) 8:130; May et al. *Am J Health Syst Pharm*. (2016) 73(1):e6-e13; the disclosures of which are incorporated herein by reference in their entirety.

In some instances, a chimeric bispecific binding member may be a bispecific antibody. In some instances, a bispecific antibody that may be expressed in response to activation of a chimeric polypeptide of the present disclosure may be a bispecific antibody targeting at least one cancer antigen (including e.g., two cancer antigens) including but not limited to e.g., at least one (including e.g., two) cancer antigens described herein. In some instances, a bispecific antibody that may be expressed in response to activation of a chimeric polypeptide of the present disclosure may be a bispecific antibody targeting at one cancer antigen and one immune cell antigen including but not limited to e.g., a cancer antigen described herein and an immune antigen described herein.

In some instances, a bispecific antibody that may be expressed in response to activation of a chimeric polypeptide of the present disclosure may be e.g., bsAb MDX-210 (targeting Her2 and CD64), MDX-H210 (targeting Her2 and CD64), MDX-447 (targeting EGFR and CD64), HRS-3/A9 (a bispecific F(ab')2 antibody targeting the CD30 antigen and receptor FcγRIII (CD16)), an anti-CD3× anti-EpCAM TriomAb/bsAb, Catumaxomab, Ertumaxomab, Bi20 (Lymphomun or fBTA05), an anti-CD19×CD3 diabody, an anti-CD19×CD16 diabody, an anti-EGFR×CD3 diabody, an anti-PSMA×CD3 diabody, a diabody targeting rM28 and NG2, an anti-CD28×CD20 bispecific tandem scFv, or the like.

In some instances, a chimeric bispecific binding member may be a bispecific T cell engager (BiTE). A BiTE is generally made by fusing a specific binding member (e.g., a scFv) that binds an immune cell antigen to a specific binding member (e.g., a scFv) that binds a cancer antigen (e.g., a tumor associated antigen, a tumor specific antigen, etc.). For example, an exemplary BiTE includes an anti-CD3 scFv fused to an anti-tumor associated antigen (e.g., EpCAM, CD19, etc.) scFv via a short peptide linker (e.g., a five amino acid linker, e.g., GGGGS (SEQ ID NO:216)).

In some instances, a BiTE that may be expressed in response to activation of a chimeric polypeptide of the present disclosure may be a BiTE targeting at least one cancer antigen including but not limited to e.g., a cancer antigen described herein. In some instances, a BiTE that may be expressed in response to activation of a chimeric polypeptide of the present disclosure may be a BiTE targeting one cancer antigen and one immune cell antigen including but not limited to e.g., a cancer antigen described herein and an immune antigen described herein.

In some instances, a chimeric polypeptide of the present disclosure may be expressed on a cell such that, upon binding the specific binding partner of the chimeric polypeptide, the intracellular domain of the chimeric polypeptide induces transcription of a BiTE from a nucleic acid sequence within the cell. In some instances, a chimeric polypeptide of the present disclosure may be expressed on a cell such that, upon binding a peptide-MHC specific binding partner, the intracellular domain of the chimeric polypeptide induces transcription of a BiTE. In some instances, a BiTE suitable for use as herein described includes e.g., an anti-CD3×anti-CD19 BiTE (e.g., Blinatumomab), an anti-EpCAM×anti- CD3 BiTE (e.g., MT110), an anti-CEA×anti-CD3 BiTE (e.g., MT111/MEDI-565), an anti-CD33×anti-CD3 BiTE, an anti-HER2 BiTE, an anti-EGFR BiTE, an anti-IgE BiTE, and the like.

In some instances, a chimeric bispecific binding member may be a Micabody or mutant thereof. A Micabody generally includes an antigen-specific binding portion linked to at least one domain that specifically binds a NKG2D receptor. In some instances, a Micabody or mutant thereof includes engineered MICA α1-α2 domains that specifically bind to NKG2D receptors.

In some instances, a Micabody or mutant thereof that may be expressed in response to activation of a chimeric polypeptide of the present disclosure may be a Micabody or mutant thereof targeting at least one cancer antigen including but not limited to e.g., a cancer antigen described herein. In some instances, a Micabody or mutant thereof that may be expressed in response to activation of a chimeric polypeptide of the present disclosure may be a Micabody or mutant thereof targeting HER2 (e.g., an anti-HER2 Micabody or mutants thereof). Non-limiting examples of Micabodies and related components and operating principles are described in e.g., Cho et al., *Cancer Res.* (2010) 70(24): 10121-30; Bauer et al. *Science.* (1999) 285(5428):727-9; Morvan et al. *Nat Rev Cancer.* (2016) 16(1):7-19; the disclosures of which are incorporated herein by reference in their entirety.

In some instances, a chimeric polypeptide of the present disclosure may be expressed on a cell such that, upon binding the specific binding partner of the chimeric polypeptide, the intracellular domain of the chimeric polypeptide induces transcription of a Micabody or mutant thereof from a nucleic acid sequence within the cell. In some instances, a chimeric polypeptide of the present disclosure may be expressed on a cell such that, upon binding a peptide-MHC specific binding partner, the intracellular domain of the chimeric polypeptide induces transcription of a Micabody or mutant thereof. Micabodies and mutants thereof include those developed by AvidBiotics (South San Francisco, CA) and described online at (avidbiotics(dot)com).

In some instances, a chimeric bispecific binding member may be a CAR T cell adapter. As used herein, by "CAR T cell adapter" is meant an expressed bispecific polypeptide that binds the antigen recognition domain of a CAR and redirects the CAR to a second antigen. Generally, a CAR T cell adapter will have to binding regions, one specific for an epitope on the CAR to which it is directed and a second epitope directed to a binding partner which, when bound, transduces the binding signal activating the CAR. Useful CAR T cell adapters include but are not limited to e.g., those described in Kim et al. J Am Chem Soc. (2015) 137(8): 2832-5; Ma et al. Proc Natl Acad Sci U S A. (2016) 113(4):E450-8 and Cao et al. Angew Chem Int Ed Engl. (2016) 55(26):7520-4; the disclosures of which are incorporated herein by reference in their entirety.

In some cases, a therapeutic POI that is induced by a chimeric polypeptide of the instant disclosure is an antibody. Suitable antibodies include, e.g., Natalizumab (Tysabri; Biogen Idec/Elan) targeting α4 subunit of α4β1 and α4β7 integrins (as used in the treatment of MS and Crohn's disease); Vedolizumab (MLN2; Millennium Pharmaceuticals/Takeda) targeting α4β7 integrin (as used in the treatment of UC and Crohn's disease); Belimumab (Benlysta; Human Genome Sciences/GlaxoSmithKline) targeting BAFF (as used in the treatment of SLE); Atacicept (TACI-Ig; Merck/Serono) targeting BAFF and APRIL (as used in the treatment of SLE); Alefacept (Amevive; Astellas) targeting CD2 (as used in the treatment of Plaque psoriasis, GVHD); Otelixizumab (TRX4; Tolerx/GlaxoSmithKline) targeting CD3 (as used in the treatment of T1D); Teplizumab (MGA031; MacroGenics/Eli Lilly) targeting CD3 (as used in the treatment of T1D); Rituximab (Rituxan/Mabthera; Genentech/Roche/Biogen Idec) targeting CD20 (as used in the treatment of Non-Hodgkin's lymphoma, RA (in patients with inadequate responses to TNF blockade) and CLL); Ofatumumab (Arzerra; Genmab/GlaxoSmithKline) targeting CD20 (as used in the treatment of CLL, RA); Ocrelizumab (2H7; Genentech/Roche/Biogen Idec) targeting CD20 (as used in the treatment of RA and SLE); Epratuzumab (hLL2; Immunomedics/UCB) targeting CD22 (as used in the treatment of SLE and non-Hodgkin's lymphoma); Alemtuzumab (Campath/MabCampath; Genzyme/Bayer) targeting CD52 (as used in the treatment of CLL, MS); Abatacept (Orencia; Bristol-Myers Squibb) targeting CD80 and CD86 (as used in the treatment of RA and JIA, UC and Crohn's disease, SLE); Eculizumab (Soliris; Alexion pharmaceuticals) targeting C5 complement protein (as used in the treatment of Paroxysmal nocturnal haemoglobinuria); Omalizumab (Xolair; Genentech/Roche/Novartis) targeting IgE (as used in the treatment of Moderate to severe persistent allergic asthma); Canakinumab (Ilaris; Novartis) targeting IL-1β (as used in the treatment of Cryopyrin-associated periodic syndromes, Systemic JIA, neonatal-onset multisystem inflammatory disease and acute gout); Mepolizumab (Bosatria; GlaxoSmithKline) targeting IL-5 (as used in the treatment of Hyper-eosinophilic syndrome); Reslizumab (SCH55700; Ception Therapeutics) targeting IL-5 (as used in the treatment of Eosinophilic oesophagitis); Tocilizumab (Actemra/RoActemra; Chugai/Roche) targeting IL-6R (as used in the treatment of RA, JIA); Ustekinumab (Stelara; Centocor) targeting IL-12 and IL-23 (as used in the treatment of Plaque psoriasis, Psoriatic arthritis, Crohn's disease); Briakinumab (ABT-874; Abbott) targeting IL-12 and IL-23 (as used in the treatment of Psoriasis and plaque psoriasis); Etanercept (Enbrel; Amgen/Pfizer) targeting TNF (as used in the treatment of RA, JIA, psoriatic arthritis, AS and plaque psoriasis); Infliximab (Remicade; Centocor/Merck) targeting TNF (as used in the treatment of Crohn's disease, RA, psoriatic arthritis, UC, AS and plaque psoriasis); Adalimumab (Humira/Trudexa; Abbott) targeting TNF (as used in the treatment of RA, JIA, psoriatic arthritis, Crohn's disease, AS and plaque psoriasis); Certolizumab pegol (Cimzia; UCB) targeting TNF (as used in the treatment of Crohn's disease and RA); Golimumab (Simponi; Centocor) targeting TNF (as used in the treatment of RA, psoriatic arthritis and AS); and the like.

In some cases, the antibody whose production is induced is a therapeutic antibody for the treatment of cancer. Such antibodies include, e.g., Ipilimumab targeting CTLA-4 (as used in the treatment of Melanoma, Prostate Cancer, RCC); Tremelimumab targeting CTLA-4 (as used in the treatment of CRC, Gastric, Melanoma, NSCLC); Nivolumab targeting PD-1 (as used in the treatment of Melanoma, NSCLC, RCC); MK-3475 targeting PD-1 (as used in the treatment of Melanoma); Pidilizumab targeting PD-1 (as used in the treatment of Hematologic Malignancies); BMS-936559 targeting PD-L1 (as used in the treatment of Melanoma, NSCLC, Ovarian, RCC); MEDI4736 targeting PD-L1; MPDL33280A targeting PD-L1 (as used in the treatment of Melanoma); Rituximab targeting CD20 (as used in the treatment of Non-Hodgkin's lymphoma); Ibritumomab tiuxetan and tositumomab (as used in the treatment of Lymphoma); Brentuximab vedotin targeting CD30 (as used in the treatment of Hodgkin's lymphoma); Gemtuzumab ozogamicin targeting CD33 (as used in the treatment of Acute myelogenous leukaemia); Alemtuzumab targeting CD52 (as used in the treatment of Chronic lymphocytic leukaemia); IGN101 and adecatumumab targeting EpCAM (as used in the treatment of Epithelial tumors (breast, colon and lung)); Labetuzumab targeting CEA (as used in the treatment of Breast, colon and lung tumors); huA33 targeting gpA33 (as used in the treatment of Colorectal carcinoma); Pemtumomab and oregovomab targeting Mucins (as used in the treatment of Breast, colon, lung and ovarian tumors); CC49 (minretumomab) targeting TAG-72 (as used in the treatment of Breast, colon and lung tumors); cG250 targeting CAIX (as used in the treatment of Renal cell carcinoma); J591 targeting PSMA (as used in the treatment of Prostate carcinoma); MOv18 and MORAb-003 (farletuzumab) targeting Folate-binding protein (as used in the treatment of Ovarian tumors); 3F8, ch14.18 and KW-2871 targeting Gangliosides (such as GD2, GD3 and GM2) (as used in the treatment of Neuroectodermal tumors and some epithelial tumors); hu3S193 and IgN311 targeting Le y (as used in the treatment of Breast, colon, lung and prostate tumors); Bevacizumab targeting VEGF (as used in the treatment of Tumor vasculature); IM-2C6 and CDP791 targeting VEGFR (as used in the treatment of Epithelium-derived solid tumors); Etaracizumab targeting Integrin_V_3 (as used in the treatment of Tumor vasculature); Volociximab targeting Integrin_5_3 (as used in the treatment of Tumor vasculature); Cetuximab, panitumumab, nimotuzumab and 806 targeting EGFR (as used in the treatment of Glioma, lung, breast, colon, and head and neck tumors); Trastuzumab and pertuzumab targeting ERBB2 (as used in the treatment of Breast, colon, lung, ovarian and prostate tumors); MM-121 targeting ERBB3 (as used in the treatment of Breast, colon, lung, ovarian and prostate, tumors); AMG 102, METMAB and SCH 900105 targeting MET (as used in the treatment of Breast, ovary and lung tumors); AVE1642, IMC-A12, MK-0646, R1507 and CP 751871 targeting IGF1R (as used in the treatment of Glioma, lung, breast, head and neck, prostate and thyroid cancer); KB004 and IIIA4 targeting EPHA3 (as used in the treatment of Lung, kidney and colon tumors, melanoma, glioma and haematological malignancies); Mapatumumab (HGS-ETR1) targeting TRAILR1 (as used in the treatment of Colon, lung and pancreas tumors and haematological malignancies); HGS-ETR2 and CS-1008 targeting TRAILR2; Denosumab targeting RANKL (as used in the treatment of Prostate cancer and bone metastases); Sibrotuzumab and F19 targeting FAP (as used in the treatment of Colon, breast, lung, pancreas, and head and neck tumors); 81C6 targeting Tenascin (as used in the treatment of Glioma, breast and prostate tumors); Blinatumomab (Blincyto; Amgen) targeting CD3 (as used in the treatment of ALL); pembrolizumab targeting PD-1 as used in cancer immunotherapy; 9E10 antibody targeting c-Myc; and the like.

In some cases, useful antibodies, the expression of which can be induced by a chimeric polypeptide of the instant disclosure, include but are not limited to 8H9, Abagovomab, Abciximab, Abituzumab, Abrilumab, Actoxumab, Aducanumab, Afelimomab, Afutuzumab, Alacizumab pegol, ALD518, Alirocumab, Altumomab pentetate, Amatuximab, Anatumomab mafenatox, Anetumab ravtansine, Anifrolumab, Anrukinzumab, Apolizumab, Arcitumomab, Ascrinvacumab, Aselizumab, Atezolizumab, Atinumab, Atlizumab/tocilizumab, Atorolimumab, Bapineuzumab, Basiliximab, Bavituximab, Bectumomab, Begelomab, Benralizumab, Bertilimumab, Besilesomab, Bevacizumab/Ranibizumab, Bezlotoxumab, Biciromab, Bimagrumab, Bimekizumab, Bivatuzumab mertansine, Blosozumab, Bococizumab, Brentuximabvedotin, Brodalumab, Brolucizumab, Brontictuzumab, Cantuzumab mertansine, Cantuzumab ravtansine, Caplacizumab, Capromab pendetide, Carlumab, Catumaxomab, cBR96-doxorubicin immunoconjugate, Cedelizumab, Ch.14.18, Citatuzumab bogatox, Cixutumumab, Clazakizumab, Clenoliximab, Clivatuzumab tetraxetan, Codrituzumab, Coltuximab ravtansine, Conatumumab, Concizumab, CR6261, Crenezumab, Dacetuzumab, Daclizumab, Dalotuzumab, Dapirolizumab pegol, Daratumumab, Dectrekumab, Demcizumab, Denintuzumab mafodotin, Derlotuximab biotin, Detumomab, Dinutuximab, Diridavumab, Dorlimomab aritox, Drozitumab, Duligotumab, Dupilumab, Durvalumab, Dusigitumab, Ecromeximab, Edobacomab, Edrecolomab, Efalizumab, Efungumab, Eldelumab, Elgemtumab, Elotuzumab, Elsilimomab, Emactuzumab, Emibetuzumab, Enavatuzumab, Enfortumab vedotin, Enlimomab pegol, Enoblituzumab, Enokizumab, Enoticumab, Ensituximab, Epitumomab cituxetan, Erlizumab, Ertumaxomab, Etrolizumab, Evinacumab, Evolocumab, Exbivirumab, Fanolesomab, Faralimomab, Farletuzumab, Fasinumab, FBTA05, Felvizumab, Fezakinumab, Ficlatuzumab, Figitumumab, Firivumab, Flanvotumab, Fletikumab, Fontolizumab, Foralumab, Foravirumab, Fresolimumab, Fulranumab, Futuximab, Galiximab, Ganitumab, Gantenerumab, Gavilimomab, Gevokizumab, Girentuximab, Glembatumumab vedotin, Gomiliximab, Guselkumab, Ibalizumab, Ibalizumab, Icrucumab, Idarucizumab, Igovomab, IMAB362, Imalumab, Imciromab, Imgatuzumab, Inclacumab, Indatuximab ravtansine, Indusatumab vedotin, Inolimomab, Inotuzumab ozogamicin, Intetumumab, Iratumumab, Isatuximab, Itolizumab, Ixekizumab, Keliximab, Lambrolizumab, Lampalizumab, Lebrikizumab, Lemalesomab, Lenzilumab, Lerdelimumab, Lexatumumab, Libivirumab, Lifastuzumab vedotin, Ligelizumab, Lilotomab satetraxetan, Lintuzumab, Lirilumab, Lodelcizumab, Lokivetmab, Lorvotuzumab mertansine, Lucatumumab, Lulizumab pegol, Lumiliximab, Lumretuzumab, Margetuximab, Maslimomab, Matuzumab, Mavrilimumab, Metelimumab, Milatuzumab, Minretumomab, Mirvetuximab soravtansine, Mitumomab, Mogamulizumab, Morolimumab, Morolimumab immune, Motavizumab, Moxetumomab pasudotox, Muromonab-CD3, Nacolomab tafenatox, Namilumab, Naptumomab estafenatox, Narnatumab, Nebacumab, Necitumumab, Nemolizumab, Nerelimomab, Nesvacumab, Nofetumomab merpentan, Obiltoxaximab, Obinutuzumab, Ocaratuzumab, Odulimomab, Olaratumab, Olokizumab, Onartuzumab, Ontuxizumab, Opicinumab, Oportuzumab monatox, Orticumab, Otlertuzumab, Oxelumab, Ozanezumab, Ozoralizumab, Pagibaximab, Palivizumab, Pankomab, Panobacumab, Parsatuzumab, Pascolizumab, Pasotuxizumab, Pateclizumab, Patritumab, Perakizumab, Pexelizumab, Pinatuzumab vedotin, Pintumomab, Placulumab, Polatuzumab vedotin, Ponezumab, Priliximab, Pritoxaximab, Pritumumab, PRO 140, Quilizumab, Racotumomab, Radretumab, Rafivirumab, Ralpancizumab, Ramucirumab, Ranibizumab, Raxibacumab, Refanezumab, Regavirumab, Rilotumumab, Rinucumab, Robatumumab, Roledumab, Romosozumab, Rontalizumab, Rovelizumab, Ruplizumab, Sacituzumab govitecan, Samalizumab, Sarilumab, Satumomab pendetide, Secukinumab, Seribantumab, Setoxaximab, Sevirumab, SGN-CD19A, SGN-CD33A, Sifalimumab, Siltuximab, Simtuzumab, Siplizumab, Sirukumab, Sofituzumab vedotin, Solanezumab, Solitomab, Sonepcizumab, Sontuzumab, Stamulumab, Sulesomab, Suvizumab, Tabalumab, Tacatuzumab tetraxetan, Tadocizumab, Talizumab, Tanezumab, Taplitumomab paptox, Tarextumab, Tefibazumab, Telimomab aritox, Tenatumomab, Teneliximab, Teprotumumab, Tesidolumab, Tetulomab, TGN1412, Ticilimumab/tremelimumab, Tigatuzumab, Tildrakizumab, TNX-650, Toralizumab, Tosatoxumab, Tovetumab, Tralokinumab, TRBS07, Tregalizumab, Trevogrumab, Tucotuzumab celmoleukin, Tuvirumab, Ublituximab, Ulocuplumab, Urelumab, Urtoxazumab, Vandortuzumab vedotin, Vantictumab, Vanucizumab, Vapaliximab, Varlilumab, Vatelizumab, Veltuzumab, Vepalimomab, Vesencumab, Visilizumab, Vorsetuzumab mafodotin, Votumumab, Zalutumumab, Zanolimumab, Zatuximab, Ziralimumab, Zolimomab aritox, and the like.

In some instances, a proteolytically cleavable chimeric polypeptide of the instant disclosure may induce the expression of a T-cell receptor (TCR) in a cell. Any TCR can be induced by a chimeric polypeptide using a method of the present disclosure including e.g., TCRs that are specific for any of a variety of epitopes, including, e.g., an epitope expressed on the surface of a cancer cell, a peptide-MHC complex on the surface of cancer cell, and the like. A TCR generally includes an alpha chain and a beta chain; and recognizes antigen when presented by a major histocompatibility complex. In some cases, the TCR is an engineered TCR.

Any engineered TCR having immune cell activation function can be induced using a method of the present disclosure. Such TCRs include, e.g., antigen-specific TCRs, Monoclonal TCRs (MTCRs), Single chain MTCRs, High Affinity CDR2 Mutant TCRs, CD1-binding MTCRs, High Affinity NY-ESO TCRs, VYG HLA-A24 Telomerase TCRs, including e.g., those described in PCT Pub Nos. WO 2003/020763, WO 2004/033685, WO 2004/044004, WO 2005/114215, WO 2006/000830, WO 2008/038002, WO 2008/039818, WO 2004/074322, WO 2005/113595, WO 2006/125962; Strommes et al. Immunol Rev. 2014; 257(1):145-64; Schmitt et al. Blood. 2013; 122(3):348-56; Chapuls et al. Sci Transl Med. 2013; 5(174):174ra27; Thaxton et al. Hum Vaccin Immunother. 2014; 10(11):3313-21 (PMID: 25483644); Gschweng et al. Immunol Rev. 2014; 257(1): 237-49 (PMID:24329801); Hinrichs et al. Immunol Rev. 2014; 257(1):56-71 (PMID:24329789); Zoete et al. Front Immunol. 2013; 4:268 (PMID:24062738); Man et al. Clin Exp Immunol. 2012; 167(2):216-25 (PMID:22235997); Zhang et al. Adv Drug Deliv Rev. 2012; 64(8):756-62 (PMID:22178904); Chhabra et al. Scientific World Journal. 2011; 11:121-9 (PMID:21218269); Boulter et al. Clin Exp Immunol. 2005; 142(3):454-60 (PMID:16297157); Sami et al. Protein Eng Des Sel. 2007; 20(8):397-403; Boulter et al. Protein Eng. 2003; 16(9):707-11; Ashfield et al. IDrugs. 2006; 9(8):554-9; Li et al. Nat Biotechnol. 2005; 23(3):349-54; Dunn et al. Protein Sci. 2006; 15(4):710-21; Liddy et al. Mol Biotechnol. 2010; 45(2); Liddy et al. Nat Med. 2012; 18(6):980-7; Oates, et al. Oncoimmunology. 2013; 2(2): e22891; McCormack, et al. Cancer Immunol Immunother. 2013 April; 62(4):773-85; Bossi et al. Cancer Immunol Immunother. 2014; 63(5):437-48 and Oates, et al. Mol Immunol. 2015 October; 67(2 Pt A):67-74; the disclosures of which are incorporated herein by reference in their entirety.

In some instances, a chimeric polypeptide of the instant disclosure induces expression of an engineered TCR targeting a cancer antigen, including e.g., an intracellular cancer antigen. In some instances, an engineered TCR induced to be expressed by a chimeric polypeptide of the instant disclosure is an engineered TCR targeting an antigen target listed in Table 2 below.

TABLE 2

Engineered TCR Targets

| Target | HLA | References |
|---|---|---|
| NY-ESO-1 | HLA-A2 | J Immunol. (2008) 180 (9): 6116-31 |
| MART-1 | HLA-A2 | J Immunol. (2008) 180 (9): 6116-31; Blood. (2009) 114 (3):535-46 |
| MAGE-A3 | HLA-A2 | J Immunother. (2013) 36 (2): 133-51 |
| MAGE-A3 | HLA-A1 | Blood. (2013) 122 (6): 863-71 |
| CEA | HLA-A2 | Mol Ther. (2011) 19 (3): 620-626 |
| gp100 | HLA-A2 | Blood. (2009) 114 (3): 535-46 |
| WT1 | HLA-A2 | Blood. (2011) 118 (6): 1495-503 |
| HBV | HLA-A2 | J Hepatol. (2011) 55 (1): 103-10 |
| gag (WT and/or α/6) | HLA-A2 | Nat Med. (2008) 14 (12): 1390-5 |
| P53 | HLA-A2 | Hum Gene Ther. (2008) 19 (11): 1219-32 |
| TRAIL bound to DR4 | N/A | J Immunol. (2008) 181 (6): 3769-76 |
| HPV-16 (E6 and/or E7) | HLA-A2 | Clin Cancer Res. (2015) 21 (19): 4431-9 |
| Survivin | HLA-A2 | J Clin Invest. (2015) 125 (1): 157-68 |
| KRAS mutants | HLA-A11 | Cancer Immunol Res. (2016) 4 (3): 204-14 |
| SSX2 | HLA-A2 | PLoS One. (2014) 9 (3): e93321 |
| MAGE-A10 | HLA-A2 | J ImmunoTherapy Cancer. (2015) 3 (Supp12): P14 |
| MAGE-A4 | HLA-A24 | Clin Cancer Res. (2015) 21 (10): 2268-77 |
| AFP | HLA-A2 | J ImmunoTherapy Cancer. (2013) 1 (Suppl1): P10 |

In some instances, an expressed TCR targeting a particular antigen may be described as an anti-[antigen] TCR. Accordingly, in some instances, exemplary TCRs that may be induced to be expressed by a chimeric polypeptide of the instant disclosure include but are not limited to e.g., an anti-NY-ESO-1 TCR; an anti-MART-1 TCR; an anti-MAGE-A3 TCR; an anti-MAGE-A3 TCR; an anti-CEA TCR; an anti-gp100 TCR; an anti-WT1 TCR; an anti-HBV TCR; an anti-gag (WT and/or α/6) TCR; an anti-P53 TCR; an anti-TRAIL bound to DR4 TCR; an anti-HPV-16 (E6 and/or E7) TCR; an anti-Survivin TCR; an anti-KRAS mutants TCR; an anti-SSX2 TCR; an anti-MAGE-A10 TCR; an anti-MAGE-A4 TCR; an anti-AFP TCR; and the like.

In some instances, the TCR is an anti-NY-ESO1 TCR (e.g., an anti-HLA-A2/NY-ESO1 scTv). In some instances, the anti-NY-ESO1 TCR has the following sequence:

(SEQ ID NO: 217)
METLLGLLILWLQLQWVSSKQEVTQIPAALSVPEGENLVLNCSFTDSAIYN

LQWFRQDPGKGLTSLLLIQSSQREQTSGRLNASLDKSSGRSTLYIAASQPG

DSATYLCAVRPLLDGTYIPTFGRGTSLIVHPGSADDAKKDAAKKDGKSMSI

GLLCCAALSLLWAGPVNAGVTQTPKFQVLKTGQSMTLQCAQDMNHEYMSWY

RQDPGMGLRLIHYSVGAGTTDRGEVPNGYNVSRSTIEDFPLRLLSAAPSQT

SVYFCASSYVGDTGELFFGEGSRLTVL.

Useful TCRs include those having wild-type affinity for their respective antigen as well as those having enhanced affinity for their respective antigen. TCRs having enhanced affinity for their respective antigen may be referred to as "affinity enhanced" or "enhanced affinity" TCRs. The affinity of a TCR may enhanced by any convenient means, including but not limited to binding-site engineering (i.e., rational design), screening (e.g., TCR display), or the like. Non-limiting examples of affinity enhanced TCRs and methods of generating enhanced affinity TCRs include but are not limited to e.g., those described in PCT Pub. Nos. 20150118208, 2013256159, 20160083449; 20140349855, 20100113300, 20140371085, 20060127377, 20080292549, 20160280756, 20140065111, 20130058908, 20110038842, 20110014169, 2003276403 and the like; the disclosures of which are incorporated herein by reference in their entirety. Further engineered TCRs, modifications thereof, that may be expressed in response to release of an intracellular domain of a chimeric polypeptide of the present disclosure include e.g., those described in PCT Application No. US2017/048040; the disclosure of which is incorporated herein by reference in its entirety.

In some instances, a therapeutic POI may be an innate-immune response inducer. As used herein, by "innate-immune response inducer" is meant any protein that when expressed within a mammal induces an innate immune response. Innate immune inducers include but are not limited to e.g., proteins or fragments thereof derived from bacteria, proteins or fragments thereof derived from virus, proteins or fragments thereof derived from fungus, proteins or fragments thereof derived from a mammalian parasite, including e.g., human parasites. Any protein that induces an innate immune response when expressed by a mammalian cell may find use as an innate-immune inducer of the instant disclosure. In some instances, an innate immune response inducer may be a flagellin protein.

In some instances, a chimeric polypeptide of the present disclosure may be expressed on a cell such that, upon binding the specific binding partner of the chimeric polypeptide, the intracellular domain of the chimeric polypeptide induces transcription of an innate-immune response inducer from a nucleic acid sequence within the cell.

In some instances, a therapeutic POI may be an immune suppression factor. As used herein, by "immune suppression factor" is meant any protein that when expressed within a mammal suppresses an immune response. Immune suppression factors include but are not limited to e g, immunosuppressive cytokines (e.g., IL-10), immunosuppressive cell-to-cell signaling ligands (e.g., PD-L1), immunosuppressive secreted proteins (e.g., TGF-beta), immunosuppressive antibodies (e.g., anti-CD3 antibodies (e.g., Orthoclone OKT3 (also known as Muromonab-CD3), etc.), anti-CD25 antibodies, (e.g., Basiliximab, Daclizumab, etc.) anti-CD52 antibodies (e.g., Campath-1H (also known as alemtuzumab), etc.), and the like. Any protein that suppresses an immune response when expressed by a mammalian cell may find use as an immune suppression factor of the instant disclosure. In some instances, an immune suppression factor may be IL-10. In some instances, an immune suppression factor may be PD-L1. In some instances, an immune suppression factor may be TGF-beta. In some instances, an immune suppression factor may be an immunosuppressive antibody (e.g., (e.g., an anti-CD3 antibody (e.g., Orthoclone OKT3 (also known as Muromonab-CD3), etc.), an anti-CD25 antibody, (e.g., Basiliximab, Daclizumab, etc.) anti-CD52 antibody (e.g., Campath-1H (also known as alemtuzumab), etc.).

In some instances, a chimeric polypeptide may drive expression of two or more immune suppression factors including e.g., an immunosuppressive cytokine and an immunosuppressive cell-to-cell signaling ligand, two or more immunosuppressive cytokines, two or more immunosuppressive cell-to-cell signaling ligands, etc. In some instances, a chimeric polypeptide may drive expression of both IL-10 and PD-L1. In some instances, a chimeric polypeptide may drive expression of three or more immune suppression factors.

In some instances, a chimeric polypeptide of the present disclosure may be expressed on a cell such that, upon binding the specific binding partner of the chimeric polypeptide, the intracellular domain of the chimeric polypeptide induces transcription of an immune suppression factor from a nucleic acid sequence within the cell.

In some instances, a therapeutic POI may be chemokine. An expressed chemokine may affect one or more cellular behaviors including but not limited to cell migration. In some instances, the intracellular domain of a chimeric receptor polypeptide of the present disclosure may induce expression of a chemokine. Examples of suitable chemokines include, e.g., MIP-1, MIP-1β, MCP-1, RANTES, IP10, and the like. Additional examples of suitable chemokines include, but are not limited to, chemokine (C-C motif) ligand-2 (CCL2; also referred to as monocyte chemotactic protein-1 or MCP1); chemokine (C-C motif) ligand-3 (CCL3; also known as macrophage inflammatory protein-1A or MIP1A); chemokine (C-C motif) ligand-5 (CCL5; also known as RANTES); chemokine (C-C motif) ligand-17 (CCL17; also known as thymus and activation regulated chemokine or TARC); chemokine (C-C motif) ligand-19 (CCL19; also known as EBI1 ligand chemokine or ELC); chemokine (C-C motif) ligand-21 (CCL21; also known as 6Ckine); C-C chemokine receptor type 7 (CCR7); chemokine (C-X-C motif) ligand 9 (CXCL9; also known as monokine induced by gamma interferon or MIG); chemokine (C-X-C motif) ligand 10 (CXCL10; also known as interferon gamma-induced protein 10 or IP-10); chemokine (C-X-C motif) ligand 11 (CXCL11; also called interferon-inducible T-cell alpha chemoattractant or I-TAC); chemokine (C-X-C motif) ligand 16 (CXCL16; chemokine (C motif) ligand (XCL1; also known as lymphotactin); and macrophage colony-stimulating factor (MCSF).

Useful POIs may further include enzymes, including where such enzymes are employed for research, therapeutic, and/or industrial applications, including but not limited to e.g., oxidoreductases, transferases, hydrolases, lyases, isomerases, ligases, etc. For example, useful enzymes may include nucleases, including e.g., site-specific nucleases, such as but not limited to e.g., RNA guided nucleases (e.g., CRISPR/Cas9 site-specific nucleases and derivatives thereof (e.g., nickases), non-Cas9 site-specific nucleases (e.g., zinc-finger nucleases (ZFNs), TAL effector nucleases (TALENs), etc.) and the like. Also of use may be Cas9 variants that lack nuclease activity such as "dead Cas9" or "dCas9". Examples of enzyme POIs that may be employed include those described in PCT Pub. No. WO 2016/138034; the disclosure of which is incorporated herein by reference in its entirety.

Certain intracellular domains and components thereof that may be adapted for use in chimeric polypeptides and the methods and circuits described herein include but are not limited to e.g., those described in PCT Application No. US2016/019188 (Pub. No. WO 2016/138034), the disclosure of which is incorporated herein by reference in its entirety.

Additional Polypeptides

A chimeric polypeptide of the present disclosure can further include one or more additional polypeptides, where suitable additional polypeptides include, but are not limited to, a signal sequence; an epitope tag; an affinity domain; a nuclear localization signal (NLS); and a polypeptide that produces a detectable signal. One or more additional sequences may be appended to the chimeric polypeptide at essentially any location where appropriate including e.g., at the N-terminus, at the C-terminus, between two domains (e.g., between the extracellular domain and the cleavable transmembrane domain, between the extracellular domain and the force sensor cleavage domain, between the force sensor cleavage domain and the intracellular signaling domain, etc.). Additional sequences may function with a chimeric polypeptide independently of other domains or may be associated with and function together with any domain of the chimeric polypeptide.

Signal sequences that are suitable for use in a chimeric polypeptide of the present disclosure include any eukaryotic signal sequence, including a naturally-occurring signal sequence, a synthetic (e.g., man-made) signal sequence, etc.

Suitable epitope tags include, but are not limited to, hemagglutinin (HA; e.g., YPYDVPDYA (SEQ ID NO:218); FLAG (e.g., DYKDDDDK (SEQ ID NO:219); c-myc (e.g., EQKLISEEDL; SEQ ID NO:220), and the like.

Affinity domains include peptide sequences that can interact with a binding partner, e.g., such as one immobilized on a solid support, useful for identification or purification. Multiple consecutive single amino acids, such as histidine, when fused to a chimeric polypeptide of the present disclosure, may be used for one-step purification of the recombinant chimeric polypeptide by high affinity binding to a resin column, such as nickel sepharose. Exemplary affinity domains include His5 (HHHHH) (SEQ ID NO:221), HisX6 (HHHHHH) (SEQ ID NO:222), C-myc (EQKLISEEDL) (SEQ ID NO:223), Flag (DYKDDDDK) (SEQ ID NO:224), StrepTag (WSHPQFEK) (SEQ ID NO:225), hemagglutinin, e.g., HA Tag (YPYDVPDYA) (SEQ ID NO:226), GST, thioredoxin, cellulose binding domain, RYIRS (SEQ ID NO:227), Phe-His-His-Thr (SEQ ID NO:228), chitin binding domain, S-peptide, T7 peptide, SH2 domain, C-end RNA tag, WEAAAREACCRECCARA (SEQ ID NO:229), metal binding domains, e.g., zinc binding domains or calcium binding domains such as those from calcium-binding proteins, e.g., calmodulin, troponin C, calcineurin B, myosin light chain, recoverin, S-modulin, visinin, VILIP, neurocalcin, hippocalcin, frequenin, caltractin, calpain large-subunit, S100 proteins, parvalbumin, calbindin D9K, calbindin D28K, and calretinin, inteins, biotin, streptavidin, MyoD, Id, leucine zipper sequences, and maltose binding protein.

Suitable nuclear localization signals ("NLS"; also referred to herein as "nuclear localization sequences") include, e.g., PKKKRKV (SEQ ID NO:230); KRPAATK-KAGQAKKKK (SEQ ID NO:231); MVPKKKRK (SEQ ID NO:232); MAPKKKRKVGIHGVPAA (SEQ ID NO:234); and the like. An NLS can be present at the N-terminus of a chimeric polypeptide of the present disclosure; near the N-terminus of a chimeric polypeptide of the present disclosure (e.g., within 5 amino acids, within 10 amino acids, or within 20 amino acids of the N-terminus); at the C-terminus of a chimeric polypeptide of the present disclosure; near the C-terminus of a chimeric polypeptide of the present disclosure (e.g., within 5 amino acids, within 10 amino acids, or within 20 amino acids of the C-terminus); or internally within a chimeric polypeptide of the present disclosure.

Suitable detectable signal-producing proteins include, e.g., fluorescent proteins; enzymes that catalyze a reaction that generates a detectable signal as a product; and the like.

Suitable fluorescent proteins include, but are not limited to, green fluorescent protein (GFP) or variants thereof, blue fluorescent variant of GFP (BFP), cyan fluorescent variant of GFP (CFP), yellow fluorescent variant of GFP (YFP), enhanced GFP (EGFP), enhanced CFP (ECFP), enhanced YFP (EYFP), GFPS65T, Emerald, Topaz (TYFP), Venus, Citrine, mCitrine, GFPuv, destabilised EGFP (dEGFP), destabilised ECFP (dECFP), destabilised EYFP (dEYFP), mCFPm, Cerulean, T-Sapphire, CyPet, YPet, mKO, HcRed, t-HcRed, DsRed, DsRed2, DsRed-monomer, J-Red, dimer2, t-dimer2(12), mRFP1, pocilloporin, Renilla GFP, Monster GFP, paGFP, Kaede protein and kindling protein, Phyco-biliproteins and Phycobiliprotein conjugates including B-Phycoerythrin, R-Phycoerythrin and Allophycocyanin. Other examples of fluorescent proteins include mHoneydew, mBanana, mOrange, dTomato, tdTomato, mTangerine, mStrawberry, mCherry, mGrapel, mRaspberry, mGrape2, mPlum (Shaner et al. (2005) *Nat. Methods* 2:905-909), and the like. Any of a variety of fluorescent and colored proteins from Anthozoan species, as described in, e.g., Matz et al. (1999) *Nature Biotechnol.* 17:969-973, is suitable for use.

Suitable enzymes include, but are not limited to, horse radish peroxidase (HRP), alkaline phosphatase (AP), beta-galactosidase (GAL), glucose-6-phosphate dehydrogenase, beta-N-acetylglucosaminidase, β-glucuronidase, invertase, Xanthine Oxidase, firefly luciferase, glucose oxidase (GO), and the like.

Certain additional polypeptides and components thereof that may be adapted for use in the chimeric polypeptides and the methods and circuits described herein include but are not limited to e.g., those described in PCT Application No. US2016/019188 (Pub. No. WO 2016/138034), the disclosure of which is incorporated herein by reference in its entirety.

Nucleic Acids

The present disclosure provides a nucleic acid comprising a nucleotide sequence encoding a chimeric polypeptide of the present disclosure. In some cases, a nucleic acid comprising a nucleotide sequence encoding a chimeric polypeptide of the present disclosure is contained within an expression vector. Thus, the present disclosure provides a recombinant expression vector comprising a nucleic acid comprising a nucleotide sequence encoding a chimeric polypeptide of the present disclosure. In some cases, the nucleotide sequence encoding a chimeric polypeptide of the present disclosure is operably linked to a transcriptional control element (e.g., a promoter; an enhancer; etc.). In some cases, the transcriptional control element is inducible. In some cases, the transcriptional control element is constitutive. In some cases, the promoters are functional in eukaryotic cells. In some cases, the promoters are cell type-specific promoters. In some cases, the promoters are tissue-specific promoters.

Depending on the host/vector system utilized, any of a number of suitable transcription and translation control elements, including constitutive and inducible promoters, transcription enhancer elements, transcription terminators, etc. may be used in the expression vector (see e.g., Bitter et al. (1987) *Methods in Enzymology,* 153:516-544).

A promoter can be a constitutively active promoter (i.e., a promoter that is constitutively in an active/"ON" state), it may be an inducible promoter (i.e., a promoter whose state, active/"ON" or inactive/"OFF", is controlled by an external stimulus, e.g., the presence of a particular temperature, compound, or protein.), it may be a spatially restricted promoter (i.e., transcriptional control element, enhancer, etc.)(e.g., tissue specific promoter, cell type specific promoter, etc.), and it may be a temporally restricted promoter (i.e., the promoter is in the "ON" state or "OFF" state during specific stages of embryonic development or during specific stages of a biological process, e.g., hair follicle cycle in mice).

Suitable promoter and enhancer elements are known in the art. For expression in a bacterial cell, suitable promoters include, but are not limited to, lad, lacZ, T3, T7, gpt, lambda P and trc. For expression in a eukaryotic cell, suitable promoters include, but are not limited to, light and/or heavy chain immunoglobulin gene promoter and enhancer elements; cytomegalovirus immediate early promoter; herpes simplex virus thymidine kinase promoter; early and late SV40 promoters; promoter present in long terminal repeats from a retrovirus; mouse metallothionein-I promoter; and various art-known tissue specific promoters.

In some instances, a transcriptional control element of a herein described nucleic acid may include a cis-acting regulatory sequence. Any suitable cis-acting regulatory sequence may find use in the herein described nucleic acids. For example, in some instances a cis-acting regulatory sequence may be or include an upstream activating sequence or upstream activation sequence (UAS). In some instances, a UAS of a herein described nucleic acid may be a Ga14 responsive UAS.

Suitable reversible promoters, including reversible inducible promoters are known in the art. Such reversible promoters may be isolated and derived from many organisms, e.g., eukaryotes and prokaryotes. Modification of reversible promoters derived from a first organism for use in a second organism, e.g., a first prokaryote and a second a eukaryote, a first eukaryote and a second a prokaryote, etc., is well known in the art. Such reversible promoters, and systems based on such reversible promoters but also comprising additional control proteins, include, but are not limited to, alcohol regulated promoters (e.g., alcohol dehydrogenase I (alcA) gene promoter, promoters responsive to alcohol transactivator proteins (AlcR), etc.), tetracycline regulated promoters, (e.g., promoter systems including TetActivators, TetON, TetOFF, etc.), steroid regulated promoters (e.g., rat glucocorticoid receptor promoter systems, human estrogen receptor promoter systems, retinoid promoter systems, thyroid promoter systems, ecdysone promoter systems, mifepristone promoter systems, etc.), metal regulated promoters (e.g., metallothionein promoter systems, etc.), pathogenesis-related regulated promoters (e.g., salicylic acid regulated promoters, ethylene regulated promoters, benzothiadiazole regulated promoters, etc.), temperature regulated promoters (e.g., heat shock inducible promoters (e.g., HSP-70, HSP-90, soybean heat shock promoter, etc.), light regulated promoters, synthetic inducible promoters, and the like.

Inducible promoters suitable for use include any inducible promoter described herein or known to one of ordinary skill in the art. Examples of inducible promoters include, without limitation, chemically/biochemically-regulated and physically-regulated promoters such as alcohol-regulated promoters, tetracycline-regulated promoters (e.g., anhydrotetracycline (aTc)-responsive promoters and other tetracycline-responsive promoter systems, which include a tetracycline repressor protein (tetR), a tetracycline operator sequence (tetO) and a tetracycline transactivator fusion protein (tTA)), steroid-regulated promoters (e.g., promoters based on the rat glucocorticoid receptor, human estrogen receptor, moth ecdysone receptors, and promoters from the steroid/retinoid/thyroid receptor superfamily), metal-regulated promoters (e.g., promoters derived from metallothionein (proteins that bind and sequester metal ions) genes from yeast, mouse and human), pathogenesis-regulated promoters (e.g., induced by salicylic acid, ethylene or benzothiadiazole (BTH)), temperature/heat-inducible promoters (e.g., heat shock promoters), and light-regulated promoters (e.g., light responsive promoters from plant cells).

In some cases, the promoter is a CD8 cell-specific promoter, a CD4 cell-specific promoter, a neutrophil-specific promoter, or an NK-specific promoter. For example, a CD4 gene promoter can be used; see, e.g., Salmon et al. (1993) *Proc. Natl. Acad. Sci. USA* 90: 7739; and Marodon et al. (2003) *Blood* 101:3416. As another example, a CD8 gene promoter can be used. NK cell-specific expression can be achieved by use of an Ncr1 (p46) promoter; see, e.g., Eckelhart et al. (2011) *Blood* 117:1565.

In some cases, a nucleic acid comprising a nucleotide sequence encoding a chimeric polypeptide of the present disclosure is a recombinant expression vector or is included in a recombinant expression vector. In some embodiments, the recombinant expression vector is a viral construct, e.g., a recombinant adeno-associated virus (AAV) construct, a recombinant adenoviral construct, a recombinant lentiviral construct, a recombinant retroviral construct, etc. In some cases, a nucleic acid comprising a nucleotide sequence encoding a chimeric polypeptide of the present disclosure is a recombinant lentivirus vector. In some cases, a nucleic acid comprising a nucleotide sequence encoding a chimeric polypeptide of the present disclosure is a recombinant AAV vector.

Suitable expression vectors include, but are not limited to, viral vectors (e.g. viral vectors based on vaccinia virus; poliovirus; adenovirus (see, e.g., Li et al., Invest Opthalmol Vis Sci 35:2543 2549, 1994; Borras et al., Gene Ther 6:515 524, 1999; Li and Davidson, PNAS 92:7700 7704, 1995; Sakamoto et al., Hum Gene Ther 5:1088 1097, 1999; WO 94/12649, WO 93/03769; WO 93/19191; WO 94/28938; WO 95/11984 and WO 95/00655); adeno-associated virus (see, e.g., Ali et al., Hum Gene Ther 9:81 86, 1998, Flannery et al., PNAS 94:6916 6921, 1997; Bennett et al., Invest Opthalmol Vis Sci 38:2857 2863, 1997; Jomary et al., Gene Ther 4:683 690, 1997, Rolling et al., Hum Gene Ther 10:641 648, 1999; Ali et al., Hum Mol Genet 5:591 594, 1996; Srivastava in WO 93/09239, Samulski et al., J. Vir. (1989) 63:3822-3828; Mendelson et al., Virol. (1988) 166:154-165; and Flotte et al., PNAS (1993) 90:10613-10617); SV40; herpes simplex virus; human immunodeficiency virus (see, e.g., Miyoshi et al., PNAS 94:10319 23, 1997; Takahashi et al., J Virol 73:7812 7816, 1999); a retroviral vector (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus); and the like. In some cases, the vector is a lentivirus vector. Also suitable are transposon-mediated vectors, such as piggyback and sleeping beauty vectors.

Nucleic acids of the instant disclosure may include nucleic acid sequence encoding a polypeptide of interest (POI). A POI may be essentially any polypeptide and may include but is not limited to polypeptides of research interest (e.g., reporter polypeptides, mutated polypeptides, novel synthetic polypeptides, etc.), polypeptides of therapeutic interest (e.g., naturally occurring therapeutic proteins, recombinant therapeutic polypeptides, etc.), polypeptides of industrial interest (e.g., polypeptides used in industrial applications such as e.g., manufacturing), and the like.

In some instances, a POI may be a transcriptional activator. In some instances, a POI may be a CAR. In some instances, a POI may be a TCR. In some instances, a POI may be an antibody. In some instances, a POI may be a chimeric bispecific binding member. In some instances, a POI may be an innate-immune response inducer. In some instances, a POI may be an immune suppression factor. In some instances, a POI may be a proteolytically cleavable chimeric polypeptide as described herein, e.g., as used in a multi-component circuit as describe herein.

Nucleic acids of the instant disclosure may include nucleic acid sequence encoding a regulatory nucleic acid, e.g., a regulatory RNA, including both inhibitory regulatory nucleic acids and activating regulatory nucleic acids. Regulatory nucleic acids may be essentially any non-coding nucleic acid that, when expressed, provides a direct regulatory (e.g., activating or inhibiting) function, e.g., increasing/decreasing the expression, translation or function of a protein, increasing/decreasing the expression, translation or function of a RNA encoding a protein, increasing/decreasing the expression, translation or function of another regulatory nucleic acid, etc. Non-limiting examples of regulatory nucleic acids include non-coding interfering nucleic acids that function in RNA silencing (e.g., short interfering RNAs (siRNA), double-stranded RNAs (dsRNA), micro-RNAs (miRNA), short hairpin RNAs (shRNA), short interfering oligonucleotides, short interfering nucleic acids, short interfering modified oligonucleotides, chemically-modified siRNAs, post-transcriptional gene silencing RNAs (ptgsRNA), and others. Regulatory nucleic acids may be short (e.g., 200 nucleotides or less) or long (e.g., more than 200 nucleotides) and thus encompass short regulatory nucleic acids (such as many of the interfering nucleic acids listed above) and long regulatory nucleic acids (such as e.g., long non-coding RNAs). Long non-coding RNAs (lncRNAs) do not encode proteins (or lack an open reading frame of more than 100 amino acids) and may be classified into different subtypes (Antisense, Intergenic, Overlapping, Intronic, Bidirectional, and Processed) according to the position and direction of transcription in relation to other genes (see Peschansky & Wahlestedt, Epigenetics. (2014) 9(1):3-12; Mattick & Rinn, Nat Struct Mol Biol. (2015) 22(1):5-7; the disclosures of which are incorporated herein by reference). In some embodiments, a DNA comprising a nucleotide sequence encoding a regulatory nucleic acid may be employed.

Certain nucleic acids and components thereof that may be adapted for use in the chimeric polypeptides and the methods and circuits described herein include but are not limited to e.g., those described in PCT Application No. US2016/019188 (Pub. No. WO 2016/138034), the disclosure of which is incorporated herein by reference in its entirety.

Cells

The present disclosure includes cells engineered to express a chimeric polypeptide as described herein. In some instances, cells of the instant disclosure will include a nucleic acid encoding a chimeric polypeptide as described herein. In some instances, cells of the instant disclosure will include a nucleic acid operably linked to a transcription control element, e.g., a transcriptional activator, that is responsive the freed intracellular domain of chimeric polypeptide of the instant disclosure thereby inducing expression of the nucleic acid upon activation of the chimeric polypeptide. Any polypeptide of interest may be encoded from a nucleic acid within a cell operably linked to a transcription control element responsive to a chimeric polypeptide of the instant disclosure.

A method of the present disclosure can be used to modulate an activity of any eukaryotic cell. In some cases, the cell is in vivo. In some cases, the cell is ex vivo. In some cases, the cell is in vitro. In some cases, the cell is a mammalian cell. In some cases, the cell is a human cell. In some cases, the cell is a non-human primate cell. In some cases, the cell is rodent cell. In some cases, the cell is mouse cell. In some cases, the cell is a rat cell. In some cases, the cell is an insect cell, e.g., a drosophila cell.

Suitable cells include neural cells; liver cells; kidney cells; immune cells; cardiac cells; skeletal muscle cells; smooth muscle cells; lung cells; and the like.

Suitable cells include a stem cell (e.g. an embryonic stem (ES) cell, an induced pluripotent stem (iPS) cell; a germ cell (e.g., an oocyte, a sperm, an oogonia, a spermatogonia, etc.); a somatic cell, e.g. a fibroblast, an oligodendrocyte, a glial cell, a hematopoietic cell, a neuron, a muscle cell, a bone cell, a hepatocyte, a pancreatic cell, etc.

Suitable cells include human embryonic stem cells, fetal cardiomyocytes, myofibroblasts, mesenchymal stem cells, autotransplated expanded cardiomyocytes, adipocytes, totipotent cells, pluripotent cells, blood stem cells, myoblasts, adult stem cells, bone marrow cells, mesenchymal cells, embryonic stem cells, parenchymal cells, epithelial cells, endothelial cells, mesothelial cells, fibroblasts, osteoblasts, chondrocytes, exogenous cells, endogenous cells, stem cells, hematopoietic stem cells, bone-marrow derived progenitor cells, myocardial cells, skeletal cells, fetal cells, undifferentiated cells, multi-potent progenitor cells, unipotent progenitor cells, monocytes, cardiac myoblasts, skeletal myoblasts, macrophages, capillary endothelial cells, xenogenic cells, allogenic cells, and post-natal stem cells.

In some cases, the cell is an immune cell, a neuron, an epithelial cell, and endothelial cell, or a stem cell. In some cases, the immune cell is a T cell, a B cell, a monocyte, a natural killer cell, a dendritic cell, or a macrophage. In some cases, the immune cell is a cytotoxic T cell. In some cases, the immune cell is a helper T cell. In some cases, the immune cell is a regulatory T cell (Treg).

In some cases, the cell is a stem cell. In some cases, the cell is an induced pluripotent stem cell. In some cases, the cell is a mesenchymal stem cell. In some cases, the cell is a hematopoietic stem cell. In some cases, the cell is an adult stem cell.

Suitable cells include bronchioalveolar stem cells (BASCs), bulge epithelial stem cells (bESCs), corneal epithelial stem cells (CESCs), cardiac stem cells (CSCs), epidermal neural crest stem cells (eNCSCs), embryonic stem cells (ESCs), endothelial progenitor cells (EPCs), hepatic oval cells (HOCs), hematopoetic stem cells (HSCs), keratinocyte stem cells (KSCs), mesenchymal stem cells (MSCs), neuronal stem cells (NSCs), pancreatic stem cells (PSCs), retinal stem cells (RSCs), and skin-derived precursors (SKPs)

In some cases, the stem cell is a hematopoietic stem cell (HSC), and the transcription factor induces differentiation of the HSC to differentiate into a red blood cell, a platelet, a lymphocyte, a monocyte, a neutrophil, a basophil, or an eosinophil. In some cases, the stem cell is a mesenchymal stem cell (MSC), and the transcription factor induces differentiation of the MSC into a connective tissue cell such as a cell of the bone, cartilage, smooth muscle, tendon, ligament, stroma, marrow, dermis, or fat.

Cells of the subject disclosure may be genetically modified host cells, e.g., modified with a nucleic acid of the present disclosure, i.e., host cells genetically modified with a nucleic acid comprising a nucleotide sequence encoding a chimeric polypeptide of the present disclosure. In one embodiment, the present disclosure provides a method of inducing expression of a heterologous polypeptide in a cell, e.g., a host cell genetically modified to contain a nucleic acid of the instant disclosure. The method generally involves contacting the cell with the binding partner of the specific binding member of a chimeric polypeptide of the present disclosure. Such binding induces cleavage of the force sensor cleavage domain of the chimeric polypeptide at the proteolytic cleavage site within the force sensor cleavage domain, thereby releasing the intracellular domain Release of the intracellular domain may modulate an activity of the cell, e.g., induce expression of a heterologous gene or coding sequence.

In some cases, the cell is a eukaryotic cell. In some cases, the cell is a mammalian cell, an amphibian cell, a reptile cell, an avian cell, an insect cell or a plant cell.

In some cases, the cell is a mammalian cell. In some cases, the cell is a human cell. In some cases, the cell is a mouse cell. In some cases, the cell is rat cell. In some cases, the cell is non-human primate cell. In some cases, the cell is lagomorph cell. In some cases, the cell is an ungulate cell.

In some cases, the cell is an immune cell, e.g., a T cell, a B cell, a macrophage, a dendritic cell, a natural killer cell, a monocyte, etc. In some cases, the cell is a T cell. In some cases, the cell is a cytotoxic T cell (e.g., a $CD8^+$ T cell). In some cases, the cell is a helper T cell (e.g., a $CD4^+$ T cell). In some cases, the cell is a regulatory T cell ("Treg"). In some cases, the cell is a B cell. In some cases, the cell is a macrophage. In some cases, the cell is a dendritic cell. In some cases, the cell is a peripheral blood mononuclear cell. In some cases, the cell is a monocyte. In some cases, the cell is a natural killer (NK) cell. In some cases, the cell is a $CD4^+$, $FOXP3^+$ Treg cell. In some cases, the cell is a $CD4^+$, $FOXP3^-$ Treg cell.

In some instances, the cell is obtained from an individual. For example, in some cases, the cell is a primary cell. As another example, the cell is a stem cell or progenitor cell obtained from an individual.

As one non-limiting example, in some cases, the cell is an immune cell obtained from an individual. As an example, the cell can be a T lymphocyte obtained from an individual. As another example, the cell is a cytotoxic cell (e.g., a cytotoxic T cell, a helper T cell, etc.) obtained from an individual. As another example, the cell can be a helper T cell obtained from an individual. As another example, the cell can be a regulatory T cell obtained from an individual. As another example, the cell can be an NK cell obtained from an individual. As another example, the cell can be a macrophage obtained from an individual. As another example, the cell can be a dendritic cell obtained from an individual. As another example, the cell can be a B cell obtained from an individual. As another example, the cell can be a peripheral blood mononuclear cell obtained from an individual.

In some cases, the host cell is a somatic cell, e.g. a fibroblast, a hematopoietic cell, a neuron, a pancreatic cell, a muscle cell, a bone cell, a hepatocyte, a pancreatic cell, an epithelial cell, an endothelial cell, a cardiomyocyte, a T cell, a B cell, an osteocyte, and the like.

In some cases, the cell is genetically modified to express two or more different chimeric polypeptides of the present disclosure, including but not limited to e.g., 2 different chimeric polypeptides of the present disclosure, 3 different chimeric polypeptides of the present disclosure, 4 different chimeric polypeptides of the present disclosure, 5 different chimeric polypeptides of the present disclosure, etc.

Certain cells and components and activities thereof that may be adapted for use in the chimeric polypeptides and/or be modulated in the methods and circuits described herein include but are not limited to e.g., those described in PCT Application No. US2016/019188 (Pub. No. WO 2016/138034), the disclosure of which is incorporated herein by reference in its entirety.

Methods

Methods are provided for modulating one or more cellular processes and/or activities and/or functions using chimeric polypeptides that undergo binding-induced cleavage of a force sensor cleavage domain to release an intracellular domain from the chimeric polypeptide. As described in more detail below, chimeric polypeptides of the instant disclosure may generally include: a) an extracellular domain comprising a specific binding member; b) a proteolytically cleavable force sensor cleavage domain; and c) an intracellular domain Methods of the instant disclosure include using such chimeric polypeptides to modulate one or more cellular processes and/or activities and/or functions upon binding of the specific binding member to its binding partner.

In some embodiments, methods are provided for modulating one or more cellular processes and/or activities and/or functions using chimeric polypeptides that undergo binding-induced cleavage of a vWF cleavage domain to release an intracellular domain from the chimeric polypeptide. As described in more detail below, chimeric polypeptides of such embodiments may generally include: a) an extracellular domain comprising a specific binding member; b) a proteolytically cleavable vWF cleavage domain; and c) an intracellular domain. Methods of the instant disclosure, in such embodiments, include using such vWF cleavage domain containing-chimeric polypeptides to modulate one or more cellular processes and/or activities and/or functions upon binding of the specific binding member to its binding partner.

According to the methods described herein, in some instances, chimeric polypeptides are expressed from a nucleic acid, within or introduced into a cell, which encodes the chimeric polypeptide. As such, in some instances, the instant methods may include contacting a cell with a nucleic acid encoding a chimeric polypeptide wherein such contacting is sufficient to introduce the nucleic acid into the cell. Any convenient method of introducing nucleic acids into a cell may find use herein including but not limited viral transfection, electroporation, lipofection, bombardment, chemical transformation, use of a transducible carrier (e.g., a transducible carrier protein), and the like.

Introduced nucleic acids may be maintained within the cell or may be transiently present. As such, in some instances, an introduced nucleic acid may be maintained within the cell, e.g., integrated into the genome. Any convenient method of nucleic acid integration may find use in the subject methods, including but not limited to e.g., viral-based integration, transposon-based integration, homologous recombination-based integration, and the like. In some instance, an introduced nucleic acid may be transiently present, e.g., extrachromosomally present within the cell. Transiently present nucleic acids may persist, e.g., as part of any convenient transiently transfected vector.

An introduced nucleic acid encoding a chimeric polypeptide of the instant disclosure may be introduced in such a manner as to be operably linked to a promoter that drives the expression of the chimeric polypeptide. The source of such promoters may vary and may include e.g., where the promoter is introduced with the nucleic acid, e.g., as part of an expression construct or where the promoter is present in the cell prior to introducing the nucleic acid or introduced after the nucleic acid. As described in more detail herein, useful promoters can include endogenous promoters and heterologous promoters. For example, in some instances, a nucleic acid may be introduced as part of an expression construct containing a heterologous promoter operably linked to the nucleic acid. In some instances, a nucleic acid may be introduced as part of an expression construct containing a copy of a promoter that is endogenous to the cell into which the nucleic acid is introduced. In some instances, a nucleic acid may be introduced without a promoter and, upon integration into the genome of the cell, the nucleic acid may be operably linked to an endogenous promoter already present in the cell. Depending on the confirmation and/or the promoter utilized, expression of the chimeric polypeptide from the nucleic acid may be configured to be constitutive, inducible, tissue-specific, cell-type specific, etc., including combinations thereof.

Chimeric polypeptides of the instant disclosure within a cell, regardless of the method of introduction, generally will reside in the plasma membrane and remain inactive when the specific binding member of such a chimeric polypeptide is not bound by its binding partner. As used herein, in relationship to chimeric polypeptides of the instant disclosure, by "inactive" is meant the intracellular domain of the chimeric polypeptide remains linked to the cleavable polypeptide (e.g., force sensor cleavable domain containing polypeptide) such that the intracellular domain is sequestered and unable to modulate intracellular functions and/or cellular activities. Upon binding of the specific binding member to its binding partner the chimeric polypeptide may be said to become active, wherein the term "active" generally refers to the release of the intracellular domain from the chimeric polypeptide by a cleavage event triggered by the binding, such that the intracellular domain is freed and may influence intracellular functions and/or cellular activities.

Cellular processes and/or activities and/or functions that may be modulated according to the instant methods will vary any may include but are not limited to modulating expression of a gene or other coding sequence, e.g., inducing expression of a gene or coding sequence, repressing expression of a gene or coding sequence, etc. Accordingly, in some instances, the intracellular domain of a chimeric polypeptide used in the subject methods may include a transcriptional modulator, including e.g., a transcriptional activator or a transcriptional repressor.

In some instances, cellular processes and/or activities and/or functions that may be modulated include but are not limited to e.g., expression of a gene product of the cell, proliferation of the cell, apoptosis of the cell, non-apoptotic death of the cell, differentiation of the cell, dedifferentiation of the cell, migration of the cell, secretion of a molecule from the cell (e.g., secretion of a therapeutic polypeptide, secretion of a cytokine, etc.), cellular adhesion of the cell, immune cell activation (e.g., T cell activation, etc.), production of effector molecules (e.g., cytokines, antibodies, growth factors, etc.), transcription of a target nucleic acid, translation of a target mRNA, organelle activity, intracellular trafficking, and the like.

In some instances, the expression and/or secretion of a cytokine may be modulated. Non-limiting examples of cytokines, the expression/secretion of which may be modulated, include but are not limited to e.g., Interleukins and related (e.g., IL-1-like, IL-1α, IL-1β, IL-1RA, IL-18, IL-2, IL-4, IL-7, IL-9, IL-13, IL-15, IL-3, IL-5, GM-CSF, IL-6-like, IL-6, IL-11, G-CSF, IL-12, LIF, OSM, IL-10-like, IL-10, IL-20, IL-14, IL-16, IL-17, etc.), Interferons (e.g., IFN-α, IFN-β, IFN-γ, etc.), TNF family (e.g., CD154, LT-β, TNF-α, TNF-β, 4-1BBL, APRIL, CD70, CD153, CD178, GITRL, LIGHT, OX40L, TALL-1, TRAIL, TWEAK, TRANCE, etc.), TGF-β family (e.g., TGF-β1, TGF-β2, TGF-β3, etc.) and the like. In some instances, activation of a cell through a chimeric polypeptide of the present disclosure, or a plurality thereof, may induce an increase in cytokine expression and/or secretion relative to that of a comparable cell where the chimeric polypeptide is not present or otherwise inactive.

In some instances, the methods described herein include methods of inducing expression of a polypeptide in a cell expressing a chimeric polypeptide of the instant disclosure by contacting the cell with a binding partner of the specific binding member of the chimeric polypeptide. Depending on the particular configuration, such methods may include inducing expression of an endogenous gene or coding sequence or a heterologous gene or coding sequence. In some instances, the binding partner of the specific binding member may be present on the surface of a cell. In some instances, the binding partner of the specific binding member may not be present on the surface of a cell and may be e.g., bound to a substrate (e.g., a solid support such as the surface of a plate or bead), unbound or freely diffusible, etc. Accordingly, where methods described herein include contacting a cell with a binding partner of a specific binding member of a chimeric polypeptide, such contacting may include but is not limited to e.g., contacting with medium containing freely diffusible binding partner, contacting with cells expressing the binding partner on their surface, contacting with a substrate with attached binding partner, etc. Unbound or freely diffusible specific binding members may, in some instances, function as a soluble adaptor molecule, e.g., facilitating binding between an anchor cell and a receiver cell to generate the force necessary to activate a subject cleavable chimeric polypeptide, e.g., as described in PCT Application No. US2016/019188 (Pub. No. WO 2016/138034); the disclosure of which is incorporated herein by reference in its entirety. In some instances, an unbound or freely diffusible binding partner may be subsequently captured or anchored by any other convenient means, including but not limited to e.g., the introduction of an additional binding partner that specifically binds the unbound or freely diffusible binding partner and is bound to or otherwise associated with a substrate or the surface of a cell.

In the subject methods, any convenient pair of specific binding member and binding partner may be utilized, provided the pair specifically binds to one another sufficiently to activate the chimeric polypeptide. In some instances, a useful pair of specific binding member and binding partner may include an antigen-antibody pair, where e.g., the antibody is utilized as the specific binding member and the antigen as the binding partner or the antigen is utilized as the specific binding member and the antibody as the binding partner.

In some instances, the methods described herein include methods of modulating a cellular activity of a cell expressing a chimeric polypeptide by contacting the cell with a peptide-major histocompatibility complex (peptide-MHC) under conditions sufficient for the peptide-MHC to bind the specific binding member of the chimeric polypeptide. In some instances, the binding of the peptide-MHC to the chimeric polypeptide activates the chimeric polypeptide releasing the intracellular domain and inducing expression of a polypeptide within the cell.

Where methods of the instant disclosure include contacting a cell expressing a chimeric polypeptide with a binding partner to induce expression of a gene or coding sequence, essentially any polypeptide, natural or recombinant, may be induced to be expressed. In some instances, an expressed polypeptide may be referred to as a polypeptide of interest (POI). A POI may be essentially any polypeptide and may include but is not limited to polypeptides of research interest (e.g., reporter polypeptides, mutated polypeptides, novel synthetic polypeptides, etc.), polypeptides of therapeutic interest (e.g., naturally occurring therapeutic proteins, recombinant therapeutic polypeptides, etc.), polypeptides of industrial interest (e.g., polypeptides used in industrial applications such as e.g., manufacturing), and the like.

In some instances, polypeptides induced to be expressed may include but are not limited to e.g., reporter proteins, chimeric antigen receptors (CAR), antibodies, chimeric bispecific binding members, engineered T cell receptors (TCR), innate-immune response inducers, etc.

Where methods of the instant disclosure include contacting a cell expressing a chimeric polypeptide with a binding partner to induce expression of a nucleic acid sequence, in some instances the expressed nucleic acid may be a regulatory nucleic acid (i.e., a non-coding nucleic acid (such as a regulatory RNA) that provides a direct (i.e., not mediated through translation of a polypeptide from regulatory nucleic acid sequence) regulatory (e.g., activating or inhibiting) function. Essentially any regulatory nucleic acid, natural or recombinant, may be induced to be expressed. As will be readily understood, in many instances herein describing the use of a POI, a suitable regulatory nucleic acid may be substituted.

"Contacting" of the instant methods may vary depending on the context and may include in vitro contacting, ex vivo contacting, and in vivo contacting. For example, in some instances, e.g., where a cell expressing a chimeric polypeptide is cultured in vitro, the contacting may include adding the binding partner or a cell expressing the binding partner or a substrate, with the binding partner attached, to the in vitro culture. In some instances, e.g., where the binding partner is present in an individual in vivo, including e.g., present on a cell present in the individual in vivo, the contacting may include administering a cell expressing the chimeric polypeptide to the individual. In some instances, e.g., where the cell expressing the chimeric polypeptide is present in an individual in vivo the contacting may include administering the binding partner to the individual, removing the cell from the individual and contacting the cell with the binding partner ex vivo, causing or allowing both the chimeric polypeptide and the binding partner to be simultaneously expressed in vivo, etc.

Methods of the present disclosure for modulating the activity of a cell can be carried out in a single cell, or in a multicellular environment (e.g., a naturally-occurring tissue; an artificial tissue; etc.). Methods of the present disclosure for modulating the activity of a cell can be carried out in parallel or in series.

Methods of the instant disclosure may further include culturing a cell expressing a chimeric polypeptide of the instant disclosure including but not limited to e.g., culturing the cell prior to contacting the cell with the binding partner, culturing the cell while contacting the cell with the binding partner, culturing the cell following contacting the cell with the binding partner. Any convenient method of cell culture may be employed whereas such methods will vary based on various factors including but not limited to e.g., the type of cell being cultured, the intended use of the cell (e.g., whether the cell is cultured for research or therapeutic purposes), etc. In some instances, methods of the instant disclosure may further include common processes of cell culture including but not limited to e.g., seeding cell cultures, feeding cell cultures, passaging cell cultures, splitting cell cultures, analyzing cell cultures, treating cell cultures with a drug, harvesting cell cultures, etc.

Methods of the instant disclosure may, in some instances, further include receiving and/or collecting cells that are used in the subject methods. In some instances, cells are collected from a subject. Collecting cells from a subject may include obtaining a tissue sample from the subject and enriching, isolating and/or propagating the cells from the tissue sample. Isolation and/or enrichment of cells may be performed using any convenient method including e.g., isolation/enrichment by culture (e.g., adherent culture, suspension culture, etc.), cell sorting (e.g., FACS), and the like. Cells may be collected from any convenient cellular tissue sample including but not limited to e.g., blood (including e.g., peripheral blood, cord blood, etc.), bone marrow, a biopsy, a skin sample, a cheek swab, etc. In some instances, cells are received from a source including e.g., a blood bank, tissue bank, etc. Received cells may have been previously isolated or may be received as part of a tissue sample thus isolation/enrichment may be performed after receiving the cells and prior to use. In certain instances, received cells may be non-primary cells including e.g., cells of a cultured cell line. Suitable cells for use in the herein described methods are further detailed herein.

Methods of Treatment

Methods of the present disclosure include methods of treating a subject using one or more chimeric polypeptides comprising a force sensor cleavage domain as described herein. In some embodiments, such methods include treating a subject using one or more chimeric polypeptides comprising a vWF cleavage domain. Any convenient method of delivering the chimeric polypeptide may find use in the subject methods. In some instances, the subject chimeric polypeptides may be delivered by administering to the subject a cell expressing the chimeric polypeptide. In some instances, the subject chimeric polypeptides may be delivered by administering to the subject a nucleic acid comprising a nucleotide sequence encoding the chimeric polypeptide. Administering to a subject a nucleic acid encoding the chimeric polypeptide may include administering to the subject a cell containing the nucleic acid where the nucleic acid may or may not yet be expressed. In some instances, administering to a subject a nucleic acid encoding the chimeric polypeptide may include administering to the subject a vector designed to deliver the nucleic acid to a cell.

Accordingly, in the subject methods of treatment, nucleic acids encoding chimeric polypeptides may be administered in vitro, ex vivo or in vivo. In some instances, cells may be collected from a subject and transfected with nucleic acid and the transfected cells may be administered to the subject, with or without further manipulation including but not limited to e.g., in vitro expansion. In some instances, the nucleic acid, e.g., with or without a delivery vector, may be administered directly to the subject.

Given the diversity of cellular activities that may be modulated through the use of the subject chimeric polypeptides comprising a force sensor cleavable domain, the instant methods of treatment may be utilized for a variety of applications. As non-limiting examples, the instant methods may find use in a treatment directed to a variety of diseases including but not limited to e.g., Acanthamoeba infection, *Acinetobacter* infection, Adenovirus infection, ADHD (Attention Deficit/Hyperactivity Disorder), AIDS (Acquired Immune Deficiency Syndrome), ALS (Amyotrophic Lateral Sclerosis), Alzheimer's Disease, Amebiasis, Intestinal (Entamoeba histolytica infection), Anaplasmosis, Human, Anemia, Angiostrongylus Infection, Animal-Related Diseases, Anisakis Infection (Anisakiasis), Anthrax, Aortic Aneurysm, Aortic Dissection, Arenavirus Infection, Arthritis (e.g., Childhood Arthritis, Fibromyalgia, Gout, Lupus (SLE) (Systemic lupus erythematosus), Osteoarthritis, Rheumatoid Arthritis, etc.), Ascaris Infection (Ascariasis), *Aspergillus* Infection (*Aspergillosis*), Asthma, Attention Deficit/Hyperactivity Disorder, Autism, Avian Influenza, B virus Infection (Herpes B virus), *B. cepacia* infection (*Burkholderia cepacia* Infection), Babesiosis (Babesia Infection), Bacterial Meningitis, Bacterial Vaginosis (BV), Balamuthia infection (Balamuthia mandrillaris infection), Balamuthia mandrillaris infection, Balantidiasis, Balantidium Infection (Balantidiasis), Baylisascaris Infection, Bilharzia, Birth Defects, Black Lung (Coal Workers' Pneumoconioses), Blastocystis hominis Infection, Blastocystis Infection, Blastomycosis, Bleeding Disorders, Blood Disorders, Body Lice (Pediculus humanus corporis), Borrelia burgdorferi Infection, Botulism (*Clostridium botulinim*), Bovine Spongiform Encephalopathy (BSE), Brainerd Diarrhea, Breast Cancer, Bronchiolitis, Bronchitis, Brucella Infection (Brucellosis), Brucellosis, *Burkholderia cepacia* Infection (*B. cepacia* infection), *Burkholderia mallei, Burkholderia pseudomallei* Infection, *Campylobacter* Infection (Campylobacteriosis), Campylobacteriosis, Cancer (e.g., Colorectal (Colon) Cancer, Gynecologic Cancers, Lung Cancer, Prostate Cancer, Skin Cancer, etc.), Candida Infection (Candidiasis), Candidiasis, Canine Flu, Capillaria Infection (Capillariasis), Capillariasis, Carbapenem resistant *Klebsiella pneumonia* (CRKP), Cat Flea Tapeworm, Cercarial Dermatitis, Cerebral Palsy, Cervical Cancer, Chagas Disease (Trypanosoma cruzi Infection), Chickenpox (Varicella Disease), Chikungunya Fever (CHIKV), Childhood Arthritis, German Measles (Rubella Virus), Measles, Mumps, Rotavirus Infection, Chlamydia (Chlamydia trachomatis Disease), Chlamydia pneumoniae Infection, Chlamydia trachomatis Disease, Cholera (Vibrio cholerae Infection), Chronic Fatigue Syndrome (CFS), Chronic Obstructive Pulmonary Disease (COPD), Ciguatera Fish Poisoning, Ciguatoxin, Classic Creutzfeldt-Jakob Disease, Clonchiasis, Clonorchis Infection (Clonorchiasis), *Clostridium botulinim, Clostridium difficile* Infection, *Clostridium perfringens* infection, *Clostridium tetani* Infection, Clotting Disorders, CMV (Cytomegalovirus Infection), Coal Workers' Pneumoconioses, Coccidioidomycosis, Colorectal (Colon) Cancer, Common Cold, Conjunctivitis, Cooleys Anemia, COPD (Chronic Obstructive Pulmonary Disease), Corynebacterium diphtheriae Infection, Coxiella burnetii Infection, Creutzfeldt-Jakob Disease, CRKP (Carbapenem resistant *Klebsiella pneumonia*), Crohn's Disease, Cryptococcosis, Cryptosporidiosis, Cryptosporidium Infection (Cryptosporidiosis), Cyclospora Infection (Cyclosporiasis), Cyclosporiasis, Cysticercosis, Cystoisospora Infection (Cystoisosporaiasis), Cystoisosporaiasis, Cytomegalovirus Infection (CMV), Dengue Fever (DF), Dengue Hemorrhagic Fever (DHF), Dermatophytes, Dermopathy, Diabetes, Diamond Blackfan Anemia (DBA), Dientamoeba fragilis Infection, Diphtheria (Corynebacterium diphtheriae Infection), Diphyllobothriasis, Diphyllobothrium Infection (Diphyllobothriasis), Dipylidium Infection, Dog Flea Tapeworm, Down Syndrome (Trisomy 21), Dracunculiasis, Dwarf Tapeworm (Hymenolepis Infection), *E. coli* Infection (*Escherichia coli* Infection), Ear Infection (Otitis Media), Eastern Equine Encephalitis (EEE), Ebola Hemorrhagic Fever, Echinococcosis, Ehrlichiosis, Elephantiasis, Encephalitis (Mosquito-Borne and Tick-Borne), Entamoeba histolytica infection, Enterobius vermicularis Infection, Enterovirus Infections (Non-Polio), Epidemic Typhus, Epilepsy, Epstein-Barr Virus Infection (EBV Infection), *Escherichia coli* Infection, Extensively Drug-Resistant TB (XDR TB), Fasciola Infection (Fascioliasis), Fasciolopsis Infection (Fasciolopsiasis), Fibromyalgia, Fifth Disease (Parvovirus B19 Infection), Flavorings-Related Lung Disease, Folliculitis, Food-Related Diseases, *Clostridium perfringens* infection, Fragile X Syndrome, Francisella tularensis Infection, Genital Candidiasis (Vulvovaginal Candidiasis (VVC)), Genital Herpes (Herpes Simplex Virus Infection), Genital Warts, German Measles (Rubella Virus), Giardia Infection (Giardiasis), Glanders (*Burkholderia mallei*), Gnathostoma Infection, Gnathostomiasis (Gnathostoma Infection), Gonorrhea (Neisseria gonorrhoeae Infection), Gout, Granulomatous amebic encephalitis (GAE), Group A Strep Infection (GAS) (Group A *Streptococcal* Infection), Group B Strep Infection (GBS) (Group B *Streptococcal* Infection), Guinea Worm Disease (Dracunculiasis), Gynecologic Cancers (e.g., Cervical Cancer, Ovarian Cancer, Uterine Cancer, Vaginal and Vulvar Cancers, etc.), H1N1 Flu, Haemophilus influenzae Infection (Hib Infection), Hand, Foot, and Mouth Disease (HFMD), Hansen's Disease, Hantavirus Pulmonary Syndrome (HPS), Head Lice (Pediculus humanus capitis), Heart Disease (Cardiovascular Health), Heat Stress, Hemochromatosis, Hemophilia, Hendra Virus Infection, Herpes B virus, Herpes Simplex Virus Infection, Heterophyes Infection (Heterophyiasis), Hib Infection (Haemophilus influenzae Infection), High Blood Pressure, Histoplasma capsulatum Disease, Histoplasmosis (Histoplasma capsulatum Disease), Hot Tub Rash (*Pseudomonas dermatitis* Infection), HPV Infection (Human Papillomavirus Infection), Human Ehrlichiosis, Human Immunodeficiency Virus, Human Papillomavirus Infection (HPV Infection), Hymenolepis Infection, Hypertension, Hyperthermia, Hypothermia, Impetigo, Infectious Mononucleosis, Inflammatory Bowel Disease (IBD), Influenza, Avian Influenza, H1N1 Flu, Pandemic Flu, Seasonal Flu, Swine Influenza, Invasive Candidiasis, Iron Overload (Hemochromatosis), Isospora Infection (Isosporiasis), Japanese Encephalitis, Jaundice, *K. pneumoniae* (*Klebsiella pneumoniae*), Kala-Azar, Kawasaki Syndrome (KS), Kernicterus, *Klebsiella pneumoniae* (*K. pneumoniae*), La Crosse Encephalitis (LAC), La Crosse Encephalitis virus (LACV), Lassa Fever, Latex Allergies, Lead Poisoning, Legionnaires' Disease (Legionellosis), Leishmania Infection (Leishmaniasis), Leprosy, Leptospira Infection (Leptospirosis), Leptospirosis, Leukemia, Lice, Listeria Infection (Listeriosis), Listeriosis, Liver Disease and Hepatitis, Loa loa Infection, Lockjaw, Lou Gehrig's Disease, Lung Cancer, Lupus (SLE) (Systemic lupus erythematosus), Lyme Disease (Borrelia burgdorferi Infection), Lymphatic Filariasis, Lymphedema, Lymphocytic Choriomeningitis (LCMV), Lymphogranuloma venereum Infection (LGV), Malaria, Marburg Hemorrhagic Fever, Measles, Melioidosis (*Burk-* holderia pseudomallei Infection), Meningitis (Meningococcal Disease), Meningococcal Disease, Methicillin Resistant *Staphylococcus aureus* (MRSA), Micronutrient Malnutrition, Microsporidia Infection, Molluscum Contagiosum, Monkey B virus, Monkeypox, Morgellons, Mosquito-Borne Diseases, Mucormycosis, Multidrug-Resistant TB (MDR TB), Mumps, *Mycobacterium* abscessus Infection, *Mycobacterium* avium Complex (MAC), Mycoplasma pneumoniae Infection, Myiasis, Naegleria Infection (Primary Amebic Meningoencephalitis (PAM)), Necrotizing Fasciitis, Neglected Tropical Diseases (NTD), Neisseria gonorrhoeae Infection, Neurocysticercosis, New Variant Creutzfeldt-Jakob Disease, Newborn Jaundice (Kernicterus), Nipah Virus Encephalitis, Nocardiosis, Non-Polio Enterovirus Infections, Nonpathogenic (Harmless) Intestinal Protozoa, Norovirus Infection, Norwalk-like Viruses (NLV), Novel H1N1 Flu, Onchocerciasis, Opisthorchis Infection, Oral Cancer, Orf Virus, Oropharyngeal Candidiasis (OPC), Osteoarthritis (OA), Osteoporosis, Otitis Media, Ovarian Cancer, Pandemic Flu, Paragonimiasis, Paragonimus Infection (Paragonimiasis), Parasitic Diseases, Parvovirus B19 Infection, Pediculus humanus capitis, Pediculus humanus corporis, Pelvic Inflammatory Disease (PID), Peripheral Arterial Disease (PAD), Pertussis, Phthiriasis, Pink Eye (Conjunctivitis), Pinworm Infection (Enterobius vermicularis Infection), Plague (Yersinia pestis Infection), Pneumocystis jirovecii Pneumonia, Pneumonia, Polio Infection (Poliomyelitis Infection), Pontiac Fever, Prion Diseases (Transmissible spongiform encephalopathies (TSEs)), Prostate Cancer, *Pseudomonas dermatitis* Infection, Psittacosis, Pubic Lice (Phthiriasis), Pulmonary Hypertension, Q Fever (Coxiella burnetii Infection), Rabies, Raccoon Roundworm Infection (Baylisascaris Infection), Rat-Bite Fever (RBF) (*Streptobacillus moniliformis* Infection), Recreational Water Illness (RWI), Relapsing Fever, Respiratory Syncytial Virus Infection (RSV), Rheumatoid Arthritis (RA), Rickettsia rickettsii Infection, Rift Valley Fever (RVF), Ringworm (Dermatophytes), Ringworm in Animals, River Blindness (Onchocerciasis), Rocky Mountain Spotted Fever (RMSF) (Rickettsia rickettsii Infection), Rotavirus Infection, RVF (Rift Valley Fever), RWI (Recreational Water Illness), Salmonella Infection (Salmonellosis), Scabies, Scarlet Fever, Schistosomiasis (Schistosoma Infection), Seasonal Flu, Severe Acute Respiratory Syndrome, Sexually Transmitted Diseases (STDs) (e.g., Bacterial Vaginosis (BV), Chlamydia, Genital Herpes, Gonorrhea, Human Papillomavirus Infection, Pelvic Inflammatory Disease, Syphilis, Trichomoniasis, HIV/AIDS, etc.), Shigella Infection (Shigellosis), Shingles (Varicella Zoster Virus (VZV)), Sickle Cell Disease, Single Gene Disorders, Sinus Infection (Sinusitis), Skin Cancer, Sleeping Sickness (African Trypanosomiasis), Smallpox (Variola Major and Variola Minor), Sore Mouth Infection (Orf Virus), Southern Tick-Associated Rash Illness (STARI), Spina Bifida (Myelomeningocele), Sporotrichosis, Spotted Fever Group Rickettsia (SFGR), St. Louis Encephalitis, *Staphylococcus aureus* Infection, *Streptobacillus* moniliformis Infection, *Streptococcal* Diseases, *Streptococcus pneumoniae* Infection, Stroke, Strongyloides Infection (Strongyloidiasis), Sudden Infant Death Syndrome (SIDS), Swimmer's Itch (Cercarial Dermatitis), Swine Influenza, Syphilis (Treponema pallidum Infection), Systemic lupus erythematosus, Tapeworm Infection (Taenia Infection), Testicular Cancer, Tetanus Disease (*Clostridium tetani* Infection), Thrush (Oropharyngeal Candidiasis (OPC)), Tick-borne Relapsing Fever, Tickborne Diseases (e.g., Anaplasmosis, Babesiosis, Ehrlichiosis, Lyme Disease, Tourette Syndrome (TS), Toxic Shock Syndrome (TSS), Toxocariasis (Toxocara Infection), Toxoplasmosis (Toxoplasma Infection), Trachoma Infection, Transmissible spongiform encephalopathies (TSEs), Traumatic Brain Injury (TBI), Trichinellosis (Trichinosis), Trichomoniasis (Trichomonas Infection), Tuberculosis (TB) (*Mycobacterium* tuberculosis Infection), Tularemia (Francisella tularensis Infection), Typhoid Fever (Salmonella typhi Infection), Uterine Cancer, Vaginal and Vulvar Cancers, Vancomycin-Intermediate/Resistant *Staphylococcus* aureus Infections (VISA/VRSA), Vancomycin-resistant Enterococci Infection (VRE), Variant Creutzfeldt-Jakob Disease (vCJD), Varicella-Zoster Virus Infection, Variola Major and Variola Minor, Vibrio cholerae Infection, Vibrio parahaemolyticus Infection, Vibrio vulnificus Infection, Viral Gastroenteritis, Viral Hemorrhagic Fevers (VHF), Viral Hepatitis, Viral Meningitis (Aseptic Meningitis), Von Willebrand Disease, Vulvovaginal Candidiasis (VVC), West Nile Virus Infection, Western Equine Encephalitis Infection, Whipworm Infection (Trichuriasis), Whitmore's Disease, Whooping Cough, Xenotropic Murine Leukemia Virus-related Virus Infection, Yellow Fever, Yersinia pestis Infection, Yersiniosis (Yersinia enterocolitica Infection), Zoonotic Hookworm, Zygomycosis, and the like.

In some instances, methods of treatment utilizing one or more proteolytically cleavable polypeptides of the instant disclosure may find use in treating a cancer. Cancers, the treatment of which may include the use of one or more proteolytically cleavable polypeptides of the instant disclosure, will vary and may include but are not limited to e.g., Acute Lymphoblastic Leukemia (ALL), Acute Myeloid Leukemia (AML), Adrenocortical Carcinoma, AIDS-Related Cancers (e.g., Kaposi Sarcoma, Lymphoma, etc.), Anal Cancer, Appendix Cancer, Astrocytomas, Atypical Teratoid/Rhabdoid Tumor, Basal Cell Carcinoma, Bile Duct Cancer (Extrahepatic), Bladder Cancer, Bone Cancer (e.g., Ewing Sarcoma, Osteosarcoma and Malignant Fibrous Histiocytoma, etc.), Brain Stem Glioma, Brain Tumors (e.g., Astrocytomas, Central Nervous System Embryonal Tumors, Central Nervous System Germ Cell Tumors, Craniopharyngioma, Ependymoma, etc.), Breast Cancer (e.g., female breast cancer, male breast cancer, childhood breast cancer, etc.), Bronchial Tumors, Burkitt Lymphoma, Carcinoid Tumor (e.g., Childhood, Gastrointestinal, etc.), Carcinoma of Unknown Primary, Cardiac (Heart) Tumors, Central Nervous System (e.g., Atypical Teratoid/Rhabdoid Tumor, Embryonal Tumors, Germ Cell Tumor, Lymphoma, etc.), Cervical Cancer, Childhood Cancers, Chordoma, Chronic Lymphocytic Leukemia (CLL), Chronic Myelogenous Leukemia (CML), Chronic Myeloproliferative Neoplasms, Colon Cancer, Colorectal Cancer, Craniopharyngioma, Cutaneous T-Cell Lymphoma, Duct (e.g., Bile Duct, Extrahepatic, etc.), Ductal Carcinoma In Situ (DCIS), Embryonal Tumors, Endometrial Cancer, Ependymoma, Esophageal Cancer, Esthesioneuroblastoma, Ewing Sarcoma, Extracranial Germ Cell Tumor, Extragonadal Germ Cell Tumor, Extrahepatic Bile Duct Cancer, Eye Cancer (e.g., Intraocular Melanoma, Retinoblastoma, etc.), Fibrous Histiocytoma of Bone (e.g., Malignant, Osteosarcoma, ect.), Gallbladder Cancer, Gastric (Stomach) Cancer, Gastrointestinal Carcinoid Tumor, Gastrointestinal Stromal Tumors (GIST), Germ Cell Tumor (e.g., Extracranial, Extragonadal, Ovarian, Testicular, etc.), Gestational Trophoblastic Disease, Glioma, Hairy Cell Leukemia, Head and Neck Cancer, Heart Cancer, Hepatocellular (Liver) Cancer, Histiocytosis (e.g., Langerhans Cell, etc.), Hodgkin Lymphoma, Hypopharyngeal Cancer, Intraocular Melanoma, Islet Cell Tumors (e.g., Pancreatic Neuroendocrine Tumors, etc.), Kaposi Sarcoma, Kidney Cancer (e.g., Renal Cell, Wilms Tumor, Childhood Kidney Tumors, etc.), Langerhans Cell Histiocytosis, Laryngeal Cancer, Leukemia (e.g., Acute Lymphoblastic (ALL), Acute Myeloid (AML), Chronic Lymphocytic (CLL), Chronic Myelogenous (CML), Hairy Cell, etc.), Lip and Oral Cavity Cancer, Liver Cancer (Primary), Lobular Carcinoma In Situ (LCIS), Lung Cancer (e.g., Non-Small Cell, Small Cell, etc.), Lymphoma (e.g., AIDS-Related, Burkitt, Cutaneous T-Cell, Hodgkin, Non-Hodgkin, Primary Central Nervous System (CNS), etc.), Macroglobulinemia (e.g., Waldenström, etc.), Male Breast Cancer, Malignant Fibrous Histiocytoma of Bone and Osteosarcoma, Melanoma, Merkel Cell Carcinoma, Mesothelioma, Metastatic Squamous Neck Cancer with Occult Primary, Midline Tract Carcinoma Involving NUT Gene, Mouth Cancer, Multiple Endocrine Neoplasia Syndromes, Multiple Myeloma/Plasma Cell Neoplasm, Mycosis Fungoides, Myelodysplastic Syndromes, Myelodysplastic/Myeloproliferative Neoplasms, Myelogenous Leukemia (e.g., Chronic (CML), etc.), Myeloid Leukemia (e.g., Acute (AML), etc.), Myeloproliferative Neoplasms (e.g., Chronic, etc.), Nasal Cavity and Paranasal Sinus Cancer, Nasopharyngeal Cancer, Neuroblastoma, Non-Hodgkin Lymphoma, Non-Small Cell Lung Cancer, Oral Cancer, Oral Cavity Cancer (e.g., Lip, etc.), Oropharyngeal Cancer, Osteosarcoma and Malignant Fibrous Histiocytoma of Bone, Ovarian Cancer (e.g., Epithelial, Germ Cell Tumor, Low Malignant Potential Tumor, etc.), Pancreatic Cancer, Pancreatic Neuroendocrine Tumors (Islet Cell Tumors), Papillomatosis, Paraganglioma, Paranasal Sinus and Nasal Cavity Cancer, Parathyroid Cancer, Penile Cancer, Pharyngeal Cancer, Pheochromocytoma, Pituitary Tumor, Pleuropulmonary Blastoma, Primary Central Nervous System (CNS) Lymphoma, Prostate Cancer, Rectal Cancer, Renal Cell (Kidney) Cancer, Renal Pelvis and Ureter, Transitional Cell Cancer, Retinoblastoma, Rhabdomyosarcoma, Salivary Gland Cancer, Sarcoma (e.g., Ewing, Kaposi, Osteosarcoma, Rhabdomyosarcoma, Soft Tissue, Uterine, etc.), Sézary Syndrome, Skin Cancer (e.g., Childhood, Melanoma, Merkel Cell Carcinoma, Nonmelanoma, etc.), Small Cell Lung Cancer, Small Intestine Cancer, Soft Tissue Sarcoma, Squamous Cell Carcinoma, Squamous Neck Cancer (e.g., with Occult Primary, Metastatic, etc.), Stomach (Gastric) Cancer, T-Cell Lymphoma, Testicular Cancer, Throat Cancer, Thymoma and Thymic Carcinoma, Thyroid Cancer, Transitional Cell Cancer of the Renal Pelvis and Ureter, Ureter and Renal Pelvis Cancer, Urethral Cancer, Uterine Cancer (e.g., Endometrial, etc.), Uterine Sarcoma, Vaginal Cancer, Vulvar Cancer, Waldenström Macroglobulinemia, Wilms Tumor, and the like.

In some instances, a method of the instant disclosure will include treating a neoplasia by administering to a subject having the neoplasia a cell expressing a chimeric polypeptide of the instant disclosure or a nucleic acid encoding a chimeric polypeptide of the instant disclosure. In some instances, such a method may further include administering to the subject a nucleic acid operably linked to a transcriptional control element that is regulated by the intracellular domain of the chimeric polypeptide. As used herein, the term "neoplasia" generally refers to an abnormal growth of tissue or an abnormally proliferating cell or population of cells, including but not limited to solid tumors, blood cancers, etc., including e.g., those of any cancer, including e.g., those cancers listed herein. A neoplasia may be benign or malignant.

In some instances, the instant methods may be applied to the treatment of heterogeneous tumors. As used herein, the term "heterogeneous tumors" generally refers to a tumor having at least two different types of tumor cells differentially expressing at least one antigen. For example, a heterogeneous tumor may include one type of tumor cell expressing a first antigen and a second type of tumor cell that does not express the antigen. In some instances, a heterogeneous tumor may include one type of tumor cell highly expressing a first antigen and a second type of tumor cell having low expression of the antigen. By "low expression" is meant that the antigen is expressed at a level that makes directly targeting the antigen with a therapeutic impractical. Methods of targeting a heterogeneous tumor as described herein will generally include therapeutically targeting at least two different cell types of the tumor, including e.g., two cell types that differentially express an antigen. Accordingly, the herein described method of targeting a heterogeneous tumor may allow for a therapeutic effect on a cell type of the tumor that does not express or shows low expression of an antigen of a cell type targeted in the method.

Differentially expressed antigens useful in the described methods of treating a heterogeneous tumor may essentially include any antigen that may be targeted with a specific binding member as described herein, including but not limited to e.g., cancer cell antigens (e.g., surface expressed cancer antigens, intracellular cancer antigens, etc.), tissue specific antigens, cell type specific antigens, and the like. In some instances, antigens are endogenously expressed by the cell. In some instances, an antigen may be heterologous to the cell from which it is expressed, including e.g., where an expressed heterologous protein serves as an antigen.

In some instances, a method of treating a heterogeneous tumor may include contacting the tumor with an immune cell engineered to express a chimeric polypeptide, comprising a force sensor cleavage domain, specific for a priming antigen. As used herein, the term "priming antigen" generally refers to an antigen sufficient to activate the chimeric polypeptide in the proximity of the heterogeneous tumor. In some instances, a priming antigen may be an antigen present in a subset of cells of the heterogeneous tumor, e.g., present on some cells of the heterogeneous tumor but not present in all cells of the heterogeneous tumor. In some instances, upon activation of a chimeric polypeptide by a priming antigen the freed intracellular domain of the chimeric polypeptide may induce expression of a second antigen-specific polypeptide. In some instances, the antigen of the second antigen-specific polypeptide may be referred to herein as a "therapeutic antigen" or a "killing antigen". As used herein, the term "therapeutic antigen" may generally refer to the antigen to which a therapeutic construct is directed, e.g., an antigen that is directly targeted by a therapeutic construct including but not limited to e.g., an antibody, a CAR, a TCR, a chimeric bispecific binding member, and the like. As used herein, the term "killing antigen" may generally refer to the antigen to which a construct designed to target a cell for killing is directed, e.g., an antigen that is targeted by a construct that results in killing of the cell expressing the killing antigen by an immune cell including but not limited to e.g., an antibody, a CAR, a TCR, a chimeric bispecific binding member, and the like. In some instances, the second antigen-specific polypeptide may be directed to a therapeutic antigen that is present in all or nearly all or most cells of the heterogeneous tumor.

In some instances, the methods described herein include inducing an innate immune response in a subject. In some instances, a chimeric polypeptide of the instant disclosure may induce the expression of a polypeptide that, when expressed, induces an innate immune response in a subject. As the specific binding member of a chimeric polypeptide of the instant disclosure may be engineered to activate the chimeric polypeptide in response to binding a specific antigen, in some instances, an innate immune response may be induced in response to the presence of a particular antigen. A chimeric polypeptide may be engineered to be activated by any convenient and appropriate antigen including but not limited to e.g., a cancer antigen, a cell type specific antigen, a tissue specific antigen, an infectious disease antigen (e.g., a bacterial antigen, a viral antigen, a fungal antigen, a pathogenic antigen, etc.), and the like. In some instances, the innate immune response may be locally activated e.g., based on the local presence of the antigen, e.g., an antigen locally present in a tumor, an antigen locally present in the tumor microenvironment, an antigen locally present in an infected area or tissue, etc.

In some instances, the methods described herein include controlling expression of one or more immune suppression factors in a subject. In some instances, a chimeric polypeptide of the instant disclosure may induce the expression of a polypeptide that, when expressed, induces immune suppression in a subject. As the specific binding member of a chimeric polypeptide of the instant disclosure may be engineered to activate the chimeric polypeptide in response to binding a specific antigen, in some instances, an immunosuppressive response may be induced in response to the presence of a particular antigen. A chimeric polypeptide may be engineered to be activated by any convenient and appropriate antigen including but not limited to e.g., an autoantigen (e.g., a self-antigen that induces an autoimmune response), a cell type specific antigen, a tissue specific antigen, and the like. In some instances, the immunosuppression may be locally activated e.g., based on the local presence of the antigen, e.g., an antigen locally present in a tissue, an antigen locally present in an organ, etc. In some instances, immunosuppression may be performed globally e.g., by using an antigen present globally to activate a chimeric polypeptide of the instant disclosure. In some instances, a subject in need of immunosuppression according to the herein described method may be a subject with an autoimmune disease.

As will be readily understood, the methods of treating described herein may, in some instances, be combined with one or more conventional treatments. For example, in the case of oncology, the methods described herein may, in some instances, be combined with a conventional cancer therapy including but not limited to e.g., conventional chemotherapy, conventional radiation therapy, conventional immunotherapy, surgery, etc. In some instances, the methods described herein may be used before or after a conventional therapy. For example, the methods described herein may be used as an adjuvant therapy, e.g., after a subject has seen improvement from a conventional therapy, or may be used when a subject has not responded to a conventional therapy. In some instances, the methods described herein may be used prior to an additional therapy, e.g., to prepare a subject for an additional therapy, e.g., a conventional therapy as described herein.

Conventional cancer therapies also include targeted therapies for cancer including but not limited to e.g., Ado-trastuzumab emtansine (Kadcyla) targeting HER2 (ERBB2/neu) (approved for use in Breast cancer); Afatinib (Gilotrif) targeting EGFR (HER1/ERBB1), HER2 (ERBB2/neu) (approved for use in Non-small cell lung cancer); Aldesleukin (Proleukin) targeting (approved for use in Renal cell carcinoma, Melanoma); Alectinib (Alecensa) targeting ALK (approved for use in Non-small cell lung cancer); Alemtuzumab (Campath) targeting CD52 (approved for use in B-cell chronic lymphocytic leukemia); Atezolizumab (Tecentriq) targeting PD-L1 (approved for use in Urothelial carcinoma, Non-small cell lung cancer); Avelumab (Bavencio) targeting PD-L1 (approved for use in Merkel cell carcinoma); Axitinib (Inlyta) targeting KIT, PDGFRβ, VEGFR1/2/3 (approved for use in Renal cell carcinoma); Belimumab (Benlysta) targeting BAFF (approved for use in Lupus erythematosus); Belinostat (Beleodaq) targeting HDAC (approved for use in Peripheral T-cell lymphoma); Bevacizumab (Avastin) targeting VEGF ligand (approved for use in Cervical cancer, Colorectal cancer, Fallopian tube cancer, Glioblastoma, Non-small cell lung cancer, Ovarian cancer, Peritoneal cancer, Renal cell carcinoma); Blinatumomab (Blincyto) targeting CD19/CD3 (approved for use in Acute lymphoblastic leukemia (precursor B-cell)); Bortezomib (Velcade) targeting Proteasome (approved for use in Multiple myeloma, Mantle cell lymphoma); Bosutinib (Bosulif) targeting ABL (approved for use in Chronic myelogenous leukemia); Brentuximab vedotin (Adcetris) targeting CD30 (approved for use in Hodgkin lymphoma, Anaplastic large cell lymphoma); Brigatinib (Alunbrig) targeting ALK (approved for use in Non-small cell lung cancer (ALK+)); Cabozantinib (Cabometyx, Cometriq) targeting FLT3, KIT, MET, RET, VEGFR2 (approved for use in Medullary thyroid cancer, Renal cell carcinoma); Carfilzomib (Kyprolis) targeting Proteasome (approved for use in Multiple myeloma); Ceritinib (Zykadia) targeting ALK (approved for use in Non-small cell lung cancer); Cetuximab (Erbitux) targeting EGFR (HER1/ERBB1) (approved for use in Colorectal cancer, Squamous cell cancer of the head and neck); Cobimetinib (Cotellic) targeting MEK (approved for use in Melanoma); Crizotinib (Xalkori) targeting ALK, MET, ROS1 (approved for use in Non-small cell lung cancer); Dabrafenib (Tafinlar) targeting BRAF (approved for use in Melanoma, Non-small cell lung cancer); Daratumumab (Darzalex) targeting CD38 (approved for use in Multiple myeloma); Dasatinib (Sprycel) targeting ABL (approved for use in Chronic myelogenous leukemia, Acute lymphoblastic leukemia); Denosumab (Xgeva) targeting RANKL (approved for use in Giant cell tumor of the bone); Dinutuximab (Unituxin) targeting B4GALNT1 (GD2) (approved for use in Pediatric neuroblastoma); Durvalumab (Imfinzi) targeting PD-L1 (approved for use in Urothelial carcinoma); Elotuzumab (Empliciti) targeting SLAMF7 (CS1/CD319/CRACC) (approved for use in Multiple myeloma); Enasidenib (Idhifa) targeting IDH2 (approved for use in Acute myeloid leukemia); Erlotinib (Tarceva) targeting EGFR (HER1/ERBB1) (approved for use in Non-small cell lung cancer, Pancreatic cancer); Everolimus (Afinitor) targeting mTOR (approved for use in Pancreatic, gastrointestinal, or lung origin neuroendocrine tumor, Renal cell carcinoma, Nonresectable subependymal giant cell astrocytoma, Breast cancer); Gefitinib (Iressa) targeting EGFR (HER1/ERBB1) (approved for use in Non-small cell lung cancer); Ibritumomab tiuxetan (Zevalin) targeting CD20 (approved for use in Non-Hodgkin's lymphoma); Ibrutinib (Imbruvica) targeting BTK (approved for use in Mantle cell lymphoma, Chronic lymphocytic leukemia, Waldenstrom's macroglobulinemia); Idelalisib (Zydelig) targeting PI3Kδ (approved for use in Chronic lymphocytic leukemia, Follicular B-cell non-Hodgkin lymphoma, Small lymphocytic lymphoma); Imatinib (Gleevec) targeting KIT, PDGFR, ABL (approved for use in GI stromal tumor (KIT+), Dermatofibrosarcoma protuberans, Multiple hematologic malignancies); Ipilimumab (Yervoy) targeting CTLA-4 (approved for use in Melanoma); Ixazomib (Ninlaro) targeting Proteasome (approved for use in Multiple Myeloma); Lapatinib (Tykerb) targeting HER2 (ERBB2/ neu), EGFR (HER1/ERBB1) (approved for use in Breast cancer (HER2+)); Lenvatinib (Lenvima) targeting VEGFR2 (approved for use in Renal cell carcinoma, Thyroid cancer); Midostaurin (Rydapt) targeting FLT3 (approved for use in acute myeloid leukemia (FLT3+)); Necitumumab (Portrazza) targeting EGFR (HER1/ERBB1) (approved for use in Squamous non-small cell lung cancer); Neratinib (Nerlynx) targeting HER2 (ERBB2/neu) (approved for use in Breast cancer); Nilotinib (Tasigna) targeting ABL (approved for use in Chronic myelogenous leukemia); Niraparib (Zejula) targeting PARP (approved for use in Ovarian cancer, Fallopian tube cancer, Peritoneal cancer); Nivolumab (Opdivo) targeting PD-1 (approved for use in Colorectal cancer, Head and neck squamous cell carcinoma, Hodgkin lymphoma, Melanoma, Non-small cell lung cancer, Renal cell carcinoma, Urothelial carcinoma); Obinutuzumab (Gazyva) targeting CD20 (approved for use in Chronic lymphocytic leukemia, Follicular lymphoma); Ofatumumab (Arzerra, HuMax-CD20) targeting CD20 (approved for use in Chronic lymphocytic leukemia); Olaparib (Lynparza) targeting PARP (approved for use in Ovarian cancer); Olaratumab (Lartruvo) targeting PDGFRα (approved for use in Soft tissue sarcoma); Osimertinib (Tagrisso) targeting EGFR (approved for use in Non-small cell lung cancer); Palbociclib (Ibrance) targeting CDK4, CDK6 (approved for use in Breast cancer); Panitumumab (Vectibix) targeting EGFR (HER1/ERBB1) (approved for use in Colorectal cancer); Panobinostat (Farydak) targeting HDAC (approved for use in Multiple myeloma); Pazopanib (Votrient) targeting VEGFR, PDGFR, KIT (approved for use in Renal cell carcinoma); Pembrolizumab (Keytruda) targeting PD-1 (approved for use in Classical Hodgkin lymphoma, Melanoma, Non-small cell lung cancer (PD-L1+), Head and neck squamous cell carcinoma, Solid tumors (MSI-H)); Pertuzumab (Perjeta) targeting HER2 (ERBB2/neu) (approved for use in Breast cancer (HER2+)); Ponatinib (Iclusig) targeting ABL, FGFR1-3, FLT3, VEGFR2 (approved for use in Chronic myelogenous leukemia, Acute lymphoblastic leukemia); Ramucirumab (Cyramza) targeting VEGFR2 (approved for use in Colorectal cancer, Gastric cancer or Gastroesophageal junction (GEJ) adenocarcinoma, Non-small cell lung cancer); Regorafenib (Stivarga) targeting KIT, PDGFRβ, RAF, RET, VEGFR1/2/3 (approved for use in Colorectal cancer, Gastrointestinal stromal tumors, Hepatocellular carcinoma); Ribociclib (Kisqali) targeting CDK4, CDK6 (approved for use in Breast cancer (HR+, HER2−)); Rituximab (Rituxan, Mabthera) targeting CD20 (approved for use in Non-Hodgkin's lymphoma, Chronic lymphocytic leukemia, Rheumatoid arthritis, Granulomatosis with polyangiitis); Rituximab/hyaluronidase human (Rituxan Hycela) targeting CD20 (approved for use in Chronic lymphocytic leukemia, Diffuse large B-cell lymphoma, Follicular lymphoma); Romidepsin (Istodax) targeting HDAC (approved for use in Cutaneous T-cell lymphoma, Peripheral T-cell lymphoma); Rucaparib (Rubraca) targeting PARP (approved for use in Ovarian cancer); Ruxolitinib (Jakafi) targeting JAK1/2 (approved for use in Myelofibrosis); Siltuximab (Sylvant) targeting IL-6 (approved for use in Multicentric Castleman's disease); Sipuleucel-T (Provenge) targeting (approved for use in Prostate cancer); Sonidegib (Odomzo) targeting Smoothened (approved for use in Basal cell carcinoma); Sorafenib (Nexavar) targeting VEGFR, PDGFR, KIT, RAF (approved for use in Hepatocellular carcinoma, Renal cell carcinoma, Thyroid carcinoma); Temsirolimus (Torisel) targeting mTOR (approved for use in Renal cell carcinoma); Tositumomab (Bexxar) targeting CD20 (approved for use in Non-Hodgkin's lymphoma); Trametinib (Mekinist) targeting MEK (approved for use in Melanoma, Non-small cell lung cancer); Trastuzumab (Herceptin) targeting HER2 (ERBB2/neu) (approved for use in Breast cancer (HER2+), Gastric cancer (HER2+)); Vandetanib (Caprelsa) targeting EGFR (HER1/ERBB1), RET, VEGFR2 (approved for use in Medullary thyroid cancer); Vemurafenib (Zelboraf) targeting BRAF (approved for use in Melanoma); Venetoclax (Venclexta) targeting BCL2 (approved for use in Chronic lymphocytic leukemia); Vismodegib (Erivedge) targeting PTCH, Smoothened (approved for use in Basal cell carcinoma); Vorinostat (Zolinza) targeting HDAC (approved for use in Cutaneous T-cell lymphoma); Ziv-aflibercept (Zaltrap) targeting PIGF, VEGFA/B (approved for use in Colorectal cancer); and the like.

In some instances, the methods of the instant disclosure may be used without any additional conventional therapy including e.g., where the method described herein is the sole method used to treat the subject. For example, in the case of oncology, the methods described herein may, in some instances, be the sole method used to treat the subject for a cancer.

Methods of Monitoring Cell-Cell Signaling

As summarized above, the present disclosure provides methods for monitoring cell-cell signaling using one or more of the chimeric polypeptides described herein. For example, in some instances, cell-cell signaling may be monitored between a "receiver cell" expressing a chimeric polypeptide of the present disclosure and a "sender cell" expressing the binding partner to which the subject chimeric polypeptide may bind. Monitoring of a receiver cell may include assaying one or more changes in the receiver cell in response to the presence of a sender cell. Useful responses may include but are not limited to e.g., changes in phenotype, changes in gene expression and the like. In some instances, a receiver cell may be monitored for one or more changes associated with Notch signaling, including e.g., changes associated with canonical Notch signaling (e.g., changes in expression of one or more canonical Notch signaling target genes) or changes associated with non-canonical Notch signaling (e.g., changes in expression of one or more non-canonical Notch signaling target genes).

In some embodiments, methods of monitoring a cell-cell signaling interaction between a sender cell and a receiver cell may include expressing a chimeric polypeptide from a nucleic acid in the receiver cell, including e.g., where the chimeric polypeptide includes: a) an extracellular domain comprising a first member of a binding pair; b) a force sensor cleavage domain comprising a proteolytic cleavage site; c) a cleavable transmembrane domain; and d) an intracellular domain comprising a Notch intracellular signaling domain. Such components may be linked in N-terminal to C-terminal order, including directly or indirectly covalent linked, with or without the use of intervening domains, such as, e.g., linkers. In the assay binding of the first member of the binding pair to a second member of the binding pair, present on a sender cell, induces cleavage of the force sensor cleavage domain at the proteolytic cleavage site, thereby releasing the intracellular Notch domain.

In some embodiments, methods of monitoring a cell-cell signaling interaction between a sender cell and a receiver cell may include expressing a chimeric polypeptide from a nucleic acid in the receiver cell, including e.g., where the chimeric polypeptide includes: a) an extracellular domain comprising a first member of a binding pair; b) a von Willebrand factor (vWF) cleavage domain comprising a proteolytic cleavage site; c) a cleavable transmembrane domain; and d) an intracellular domain comprising a Notch intracellular signaling domain. Such components may be linked in N-terminal to C-terminal order, including directly or indirectly covalent linked, with or without the use of intervening domains, such as, e.g., linkers. In the assay binding of the first member of the binding pair to a second member of the binding pair, present on a sender cell, induces cleavage of the vWF cleavage domain at the proteolytic cleavage site, thereby releasing the intracellular Notch domain.

In some embodiments, methods of monitoring a cell-cell signaling interaction between a sender cell and a receiver cell may include contacting a receiver cell expressing a subject chimeric polypeptide with a sender cell expressing the second member of the binding pair. Any convenient method of contacting may be employed including but not limited to e.g., where the two cell types are co-cultured, where the two cell types are present in the same tissue (e.g., an epithelium), where the two cell types are present in the same organism, etc. In some instances, the cells may be contacted by nature of their adjacent development within a tissue and/or organism, including e.g., where the cells develop adjacent to one another in an organ of a model organism (e.g., a fly, a rodent, a nematode, etc.).

In some embodiments, methods of monitoring a cell-cell signaling interaction between a sender cell and a receiver cell may include assaying a contacted receiver cell for induction of a Notch target gene, thereby monitoring the cell-cell signaling interaction between the sender cell and the receiver cell. In some instances, useful Notch target genes for monitoring a Notch associated cell-cell interaction using a chimeric polypeptide of the present disclosure may include but are not limited to e.g., drosophila cut (ct), drosophila wingless (wg), drosophila Hairy/E(spl)-related with YRPW motif (Hey), vertebrate HEY1, vertebrate HEY2, vertebrate HES1, apoptosis genes (e.g., CDKN1A, CFLAR (CASH), IL2RA and NFKB1), cell cycle regulators (e.g., CCND1, CDKN1A and IL2RA), cell proliferation genes (e.g., CDKN1A, ERBB2, FOSL1 and IL2RA), genes regulating cell differentiation (e.g., DTX1 and PPARG), neurogenesis genes (e.g., HES1 and HEY1), genes that regulate transcription (e.g., DTX1, FOS, FOSL1, HES1, HEY1, NFKB1, NFKB2, NR4A2, PPARG and STATE), CD44, CHUK, IFNG, IL17B, KRT1, LOR, MAP2K7, PDPK1, PTCRA, and the like. In some instances, the assaying may include visual inspection and/or imaging, including microscopic inspection and/or imaging, of the cells. In some instances, such visual inspection and/or imaging may include fluorescent imaging and/or microscopy, including e.g., imaging a fluorescent protein.

In one embodiment, a method of monitoring a cell-cell signaling interaction between a sender cell and a receiver cell may include: a) expressing a chimeric polypeptide of the present disclosure from a nucleic acid in the receiver cell; b) contacting the receiver cell with a sender cell expressing a second member of the binding pair to which the chimeric polypeptide specifically binds; and c) assaying the contacted receiver cell for a change associated with Notch signaling. Any convenient change associated with Notch signaling may be employed including but not limited to e.g., induction of a Notch target gene.

Circuits

The intracellular domain of a chimeric polypeptide of the present disclosure, when released upon binding of the binding partner to the specific binding member of the extracellular domain, may induce the expression of various polypeptides as described herein. In some instances, induced expression of two or more polypeptides may generate a logic gated circuit. Such logic gated circuits may include but are not limited to e.g., "AND gates", "OR gates", "NOT gates" and combinations thereof including e.g., higher order gates including e.g., higher order AND gates, higher order OR gates, higher order NOT gates, higher order combined gates (i.e., gates using some combination of AND, OR and/or NOT gates).

"AND" gates of the present disclosure include where two or more inputs are required for propagation of a signal. For example, in some instances, an AND gate allows signaling through a chimeric polypeptide of the instant disclosure and a second binding-dependent molecule. In an AND gate two inputs, e.g., two antigens, are required for signaling through the circuit.

"OR" gates of the present disclosure include where either of two or more inputs may allow for the propagation of a signal. For example, in some instances, an OR gate allows signaling through either of two different chimeric polypeptides of the instant disclosure. In an OR gate any one input, e.g., either of two antigens, may induce the signaling output of the circuit. In one embodiment, an OR gate may be achieved through the use of two separate molecules or constructs. In another embodiment, an OR gate may be achieved through the use of a single construct that recognizes two antigens, including e.g., a proteolytically cleavable chimeric polypeptide having two different specific binding members that each bind a different binding partner but either can activate the chimeric polypeptide. In some instances, an OR gate may be achieved through the use of a single construct that recognizes two antigens, including e.g., a proteolytically cleavable chimeric polypeptide having two different antibody specific binding members that each bind a different antigen but either antigen can activate the chimeric polypeptide.

"NOT" gates of the present disclosure include where an input is capable of preventing the propagation of a signal. For example, in some instances, a NOT gate inhibits signaling through a chimeric polypeptide of the instant disclosure. In one embodiment, a NOT gate may include the inhibition of a binding interaction. For example, a competitive inhibitor that prevents the binding of parts of a split chimeric polypeptide of the instant disclosure may serve as a NOT gate that prevents signaling through the circuit. In another embodiment, a NOT gate may include functional inhibition of an element of a circuit. For example, an inhibitor that functionally prevents signaling through a chimeric polypeptide of the instant disclosure or the outcome of signaling through a circuit may serve as a NOT gate.

In some instances, the production of immunosuppressive agents (e.g., an immune suppression factor) may provide NOT gate functionality in a multi-input circuit described herein.

Multi-input gates may make use of a NOT gate in various different ways to prevent signaling through some other component of a circuit or turn off a cellular response when and/or where a signal activating the NOT gate (e.g., a particular negative antigen) is present. For example, an AND+NOT gate may include a chimeric polypeptide of the instant disclosure that positively influences a particular cellular activity in the presence of a first antigen and a chimeric polypeptide of the instant disclosure that negatively influences the cellular activity in the presence of a second antigen.

Multi-input circuits and logic gated systems of the instant disclosure are not limited to those specifically described and may include alternative configurations and/or higher order gates as compared to those described. For example, in some instances a logic gated system of the instant disclosure may be a two input gate, a three input gate, a four input gate, a five input gate, a six input gate, a seven input gate, an eight input gate, a nine input gate, a ten input gate or greater. Any construct described herein including e.g., a chimeric polypeptide, a CAR, a TCR, a chimeric bispecific binding member, and the like, may find use in a circuit in conjunction with any other construct described herein including e.g., a chimeric polypeptide, a CAR, a TCR, a chimeric bispecific binding member, a second chimeric polypeptide, a second CAR, a second TCR, a second chimeric bispecific binding member, and the like, etc.

Certain circuits and components thereof that may be adapted for use with the chimeric polypeptides and the methods described herein include but are not limited to e.g., those described in PCT Application No. US2016/019188 (Pub. No. WO 2016/138034), the disclosure of which is incorporated herein by reference in its entirety.

Kits

The present disclosure provides kits for carrying out a method as described herein and/or constructing one or more chimeric polypeptides, nucleic acids encoding chimeric polypeptides, components thereof, etc.

In some cases, a subject kit comprises an expression vector comprising a nucleotide sequence encoding a chimeric polypeptide of the present disclosure or one or more portions thereof. In some cases, a subject kit comprises a chimeric polypeptide of the present disclosure.

In some cases, a subject kit comprises a cell, e.g., a host cell or host cell line, that is or is to be genetically modified with a nucleic acid comprising a nucleotide sequence encoding a chimeric polypeptide of the present disclosure. In some cases, a subject kit comprises a cell, e.g., a host cell, that is or is to be genetically modified with a recombinant expression vector comprising a nucleotide sequence encoding a chimeric polypeptide of the present disclosure. Kit components can be in the same container, or in separate containers.

Any of the above-described kits can further include one or more additional reagents, where such additional reagents can be selected from: a dilution buffer; a reconstitution solution; a wash buffer; a control reagent; a control expression vector; a negative control polypeptide (e.g., a chimeric polypeptide that lacks the one or more proteolytic cleavage sites, such that, upon binding, the intracellular domain is not released); a positive control polypeptide; a reagent for in vitro production of the chimeric polypeptide, and the like.

In addition to above-mentioned components, a subject kit can further include instructions for using the components of the kit to practice the subject methods. The instructions for practicing the subject methods are generally recorded on a suitable recording medium. For example, the instructions may be printed on a substrate, such as paper or plastic, etc. As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, flash drive, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

Examples of Non-Limiting Aspects of the Disclosure

Aspects, including embodiments, of the present subject matter described above may be beneficial alone or in combination, with one or more other aspects or embodiments. Without limiting the foregoing description, certain non-limiting aspects of the disclosure numbered as below are provided. As will be apparent to those of skill in the art upon reading this disclosure, each of the individually numbered aspects may be used or combined with any of the preceding or following individually numbered aspects. This is intended to provide support for all such combinations of aspects and is not limited to combinations of aspects explicitly provided below:

1. A chimeric polypeptide comprising, from N-terminal to C-terminal:
   a) an extracellular domain comprising a first member of a binding pair;
   b) a non-Notch force sensor cleavage domain comprising a proteolytic cleavage site;
   c) a cleavable transmembrane domain; and
   d) an intracellular domain comprising a Notch intracellular signaling domain, wherein binding of the first member of the binding pair to a second member of the binding pair, present on a cell, induces cleavage of the non-Notch force sensor cleavage domain at the proteolytic cleavage site, thereby releasing the intracellular domain, and wherein the non-Notch force sensor cleavage domain is selected from the group consisting of: a von Willebrand Factor (vWF) cleavage domain, an amyloid-beta cleavage domain, a CD16 cleavage domain, a CD44 cleavage domain, a Delta cleavage domain, a cadherin cleavage domain, an ephrin-type receptor or ephrin ligand cleavage domain, a protocadherin cleavage domain, a filamin cleavage domain, a synthetic E cadherin cleavage domain, an interleukin-1 receptor type 2 (IL1R2) cleavage domain, a major prion protein (PrP) cleavage domain, a neuregulin cleavage domain and an adhesion-GPCR cleavage domain.

2. The chimeric polypeptide according to Aspect 1, wherein the non-Notch force sensor cleavage domain is a mammalian non-Notch force sensor cleavage domain.

3. The chimeric polypeptide according to Aspect 2, wherein the mammalian non-Notch force sensor cleavage domain is a human non-Notch force sensor cleavage domain.

4. The chimeric polypeptide according to any of the preceding Aspects, wherein the non-Notch force sensor cleavage domain is a vWF cleavage domain.

5. The chimeric polypeptide according to Aspect 4, wherein the proteolytic cleavage site is an ADAM family type protease cleavage site.

6. The chimeric polypeptide according to Aspect 5, wherein the ADAM family type protease cleavage site is an ADAM-13 type protease cleavage site.

7. The chimeric polypeptide according to any of Aspects 4 to 6, wherein the vWF cleavage domain comprises a vWF A2 domain or a variant thereof.

8. The chimeric polypeptide according to any of the preceding Aspects, wherein the cleavable transmembrane domain comprises a γ-secretase cleavage site.

9. The chimeric polypeptide according to any of the preceding Aspects, wherein the cleavable transmembrane domain is a Notch transmembrane domain.

10. The chimeric polypeptide according to Aspect 9, wherein the Notch transmembrane domain comprises a γ-secretase cleavage site 11. The chimeric polypeptide according to Aspect 10, wherein the a γ-secretase cleavage site is a Notch S3 proteolytic cleavage site.

12. The chimeric polypeptide according to any of the preceding Aspects, wherein the Notch intracellular signaling domain is a drosophila Notch intracellular signaling domain.

13. The chimeric polypeptide according to any of the preceding Aspects, wherein the extracellular domain does not comprise a functional Notch ligand binding site.

14. The chimeric polypeptide according to Aspect 13, wherein the first member of the binding pair comprises at least a portion of a receptor that binds a ligand and the second member of the binding pair comprises at least a portion of the ligand.

15. The chimeric polypeptide according to Aspect 13, wherein the first member of the binding pair comprises at least a portion of a ligand that binds a receptor and the second member of the binding pair comprises at least a portion of the receptor.

16. The chimeric polypeptide according to any of the preceding Aspects, wherein the binding pair comprises a follicle stimulating hormone (FSH) polypeptide and a FSH receptor (FSHR) polypeptide.

17. The chimeric polypeptide according to any of the preceding Aspects, wherein the chimeric polypeptide further comprises a fluorescent protein polypeptide.

18. The chimeric polypeptide according to Aspect 17, wherein the fluorescent protein polypeptide is interposed between the extracellular domain and the non-Notch force sensor cleavage domain.

19. The method according to Aspect 17, wherein the fluorescent protein polypeptide is within the intracellular domain.

20. The chimeric polypeptide according to any of Aspects 17 to 19, wherein the chimeric polypeptide comprises two fluorescent proteins.

21. The chimeric polypeptide according to Aspect 20, wherein the two fluorescent proteins comprise different emission wavelengths.

22. The chimeric polypeptide according to Aspects 20 or 21, wherein one of the two fluorescent proteins is interposed between the extracellular domain and the non-Notch force sensor cleavage domain and the other fluorescent protein is within the intracellular domain.

23. A nucleic acid encoding the chimeric polypeptide according to any of Aspects 1 to 22.

24. A recombinant expression vector comprising the nucleic acid according to Aspect 23.

25. A method of monitoring a cell-cell signaling interaction between a sender cell and a receiver cell, the method comprising:
   a) expressing a chimeric polypeptide from a nucleic acid according to Aspect 23 in the receiver cell;
   b) contacting the receiver cell with a sender cell expressing the second member of the binding pair; and
   c) assaying the contacted receiver cell for induction of a Notch target gene, thereby monitoring the cell-to-cell signaling interaction between the sender cell and the receiver cell.

26. The method according to Aspect 25, wherein the second member of the binding pair is heterologous to the sender cell.

27. The method according to Aspects 25 or 26, wherein the Notch target gene is endogenous to the receiver cell.

28. The method according to any of Aspects 25 to 27, wherein the Notch target gene is selected from the group consisting of: cut (ct), wingless (wg) and homologs thereof.

29. A chimeric polypeptide comprising, from N-terminal to C-terminal:
   a) an extracellular domain comprising a first member of a binding pair;
   b) a non-Notch force sensor cleavage domain comprising a proteolytic cleavage site;
   c) a cleavable transmembrane domain; and
   d) an intracellular domain that is not a Notch intracellular signaling domain and does not induce expression of Notch target genes, wherein binding of the first member of the specific binding pair to the second member of the specific binding pair, present on a cell or other solid support, induces cleavage at the proteolytic cleavage site thereby releasing the intracellular domain, and wherein the non-Notch force sensor cleavage domain is selected from the group consisting of: a von Willebrand Factor (vWF) cleavage domain, an amyloid-beta cleavage domain, a CD16 cleavage domain, a CD44 cleavage domain, a Delta cleavage domain, a cadherin cleavage domain, an ephrin-type receptor or ephrin ligand cleavage domain, a protocadherin cleavage domain, a filamin cleavage domain, a synthetic E cadherin cleavage domain, an interleukin-1 receptor type 2 (IL1R2) cleavage domain, a major prion protein (PrP) cleavage domain, a neuregulin cleavage domain and an adhesion-GPCR cleavage domain.

30. The chimeric polypeptide according to Aspect 29, wherein the non-Notch force sensor cleavage domain is a mammalian non-Notch force sensor cleavage domain.

31. The chimeric polypeptide according to Aspect 30, wherein the mammalian non-Notch force sensor cleavage domain is a rodent non-Notch force sensor cleavage domain.

32. The chimeric polypeptide according to Aspect 31, wherein the rodent non-Notch force sensor cleavage domain is a mouse non-Notch force sensor cleavage domain.

33. The chimeric polypeptide according to Aspect 30, wherein the mammalian non-Notch force sensor cleavage domain is a human non-Notch force sensor cleavage domain.

34. The chimeric polypeptide according to any of Aspects 29 to 33, wherein the non-Notch force sensor cleavage domain is a von Willebrand Factor (vWF) cleavage domain.

35. The chimeric polypeptide according to Aspect 34, wherein the proteolytic cleavage site is an ADAM family type protease cleavage site.

36. The chimeric polypeptide according to Aspect 35, wherein the ADAM family type protease cleavage site is an ADAM-13 type protease cleavage site.

37. The chimeric polypeptide according to any of Aspects 34 to 36, wherein the vWF cleavage domain comprises a vWF A2 domain or a variant thereof.

38. The chimeric polypeptide according to any of Aspects 29 to 37, wherein the cleavable transmembrane domain comprises a γ-secretase cleavage site.

39. The chimeric polypeptide according to any of Aspects 29 to 38, wherein the cleavable transmembrane domain is a Notch transmembrane domain.

40. The chimeric polypeptide according to Aspect 39, wherein the Notch transmembrane domain comprises a γ-secretase cleavage site 41. The chimeric polypeptide according to Aspect 39, wherein the γ-secretase cleavage site is a Notch S3 proteolytic cleavage site.

42. The chimeric polypeptide according to any of Aspects 37 to 39, wherein the Notch transmembrane domain is a mammalian Notch transmembrane domain.

43. The chimeric polypeptide according to Aspect 42, wherein the mammalian Notch transmembrane domain is a rodent Notch transmembrane domain.

44. The chimeric polypeptide according to Aspect 43, wherein the rodent Notch transmembrane domain is a mouse Notch transmembrane domain.

45. The chimeric polypeptide according to Aspect 42, wherein the mammalian Notch transmembrane domain is a human Notch transmembrane domain.

46. The chimeric polypeptide according to any of Aspects 29 to 45, wherein the chimeric polypeptide further comprises a Notch extracellular domain interposed between the non-Notch force sensor cleavage domain and the cleavable transmembrane domain.

47. The chimeric polypeptide according to Aspect 46, wherein the Notch extracellular domain comprises a portion of a Notch polypeptide from between the S2 site and the transmembrane domain of the Notch polypeptide.

48. The chimeric polypeptide according to Aspect 47, wherein the Notch extracellular domain comprises the entire portion of the Notch polypeptide between the Notch S2 site and the transmembrane domain.

49. The chimeric polypeptide according to any of Aspects 29 to 48, wherein the chimeric polypeptide further comprises a Notch cytoplasmic domain interposed between the cleavable transmembrane domain and the intracellular domain.

50. The chimeric polypeptide according to Aspect 49, wherein the Notch cytoplasmic domain comprises a portion of a Notch polypeptide from between the transmembrane domain and the most N-terminal ankyrin repeat (ANK) domain of the Notch polypeptide.

51. The chimeric polypeptide according to Aspects 49 or 50, wherein the Notch cytoplasmic domain is a length of 40 amino acids or less.

52. The chimeric polypeptide according to any of Aspects 29 to 51, wherein the extracellular domain does not comprise a functional Notch ligand binding site.

53. The chimeric polypeptide according to any of Aspects 29 to 52, wherein the first member of the binding pair comprises at least a portion of a receptor that binds a ligand and the second member of the binding pair comprises at least a portion of the ligand.

54. The chimeric polypeptide according to any of Aspects 29 to 52, wherein the first member of the binding pair comprises at least a portion of a ligand that binds a receptor and the second member of the binding pair comprises at least a portion of the receptor.

55. The chimeric polypeptide according to any of Aspects 29 to 52, wherein the first member of the binding pair comprises an antibody.

56. The chimeric polypeptide according to Aspect 55, wherein the antibody is a nanobody, a diabody, a triabody, or a minibody, a F(ab')$_2$ fragment, a Fab fragment, a single chain variable fragment (scFv) or a single domain antibody (sdAb).

57. The chimeric polypeptide according to any of Aspects 29 to 56, wherein the intracellular domain comprises a transcriptional activator.

58. The chimeric polypeptide according to any of Aspects 29 to 56, wherein the intracellular domain comprises a transcriptional repressor.

59. A nucleic acid encoding the chimeric polypeptide according to any of Aspects 29 to 58.

60. The nucleic acid according to Aspect 59, wherein the nucleic acid further comprises a transcriptional control element responsive to the released intracellular domain operably linked to a nucleic acid sequence encoding a polypeptide of interest (POI).

61. The nucleic acid according to Aspect 60, wherein the POI is a heterologous polypeptide selected from the group consisting of: a reporter protein, an immunoactivator, an immune suppression factor, a transcription factor, a site-specific nuclease, a recombinase, a chimeric antigen receptor (CAR), an antibody, a chimeric bispecific binding member, an engineered T cell receptor (TCR) an innate-immune response inducer.

62. A recombinant expression vector comprising the nucleic acid according to any of Aspects 59 to 61.

63. A method of modulating expression of a heterologous polypeptide in a cell, the method comprising:
contacting a cell with a second member of a binding pair, wherein the cell expresses a chimeric polypeptide according to any of Aspects 29 to 58 and comprises a sequence encoding the heterologous polypeptide operably linked to a transcriptional control element responsive to the intracellular domain of the chimeric polypeptide, thereby releasing the intracellular domain of the chimeric polypeptide and modulating expression of the heterologous polypeptide.

64. The method according to Aspect 63, wherein the heterologous polypeptide is selected from the group consisting of: a reporter protein, an immunoactivator, an immune suppression factor, a transcription factor, a site-specific nuclease, a recombinase, a chimeric antigen receptor (CAR), an antibody, a chimeric bispecific binding member, an engineered T cell receptor (TCR) an innate-immune response inducer.

65. A method of modulating an activity of a cell that expresses a chimeric polypeptide according any one of Aspects 29 to 58, the method comprising:
contacting the cell with a second member of the specific binding pair, wherein binding of the first member of the specific binding pair to the second member of the specific binding pair induces cleavage of the chimeric polypeptide at the proteolytic cleavage site, thereby releasing the intracellular domain, wherein release of the intracellular domain modulates the activity of the cell.

66. The method according to Aspect 65, wherein said contacting is carried out in vivo, ex vivo, or in vitro.

67. The method according to Aspects 65 or 66, wherein the second member of the specific binding pair is on the surface of a second cell, is immobilized on an insoluble substrate, is present in an extracellular matrix, is present in an artificial matrix, or is soluble.

68. The method according to Aspect 67, wherein the second member of the specific binding pair is a soluble adaptor molecule anchored to a substrate.

69. The method according to Aspect 66, wherein the substrate is a cell or a non-cellular solid support.

70. The method according to any of Aspects 65 to 69, wherein release of the intracellular domain modulates proliferation of the cell.

71. The method according to any of Aspects 65 to 69, wherein release of the intracellular domain modulates apoptosis in the cell.

72. The method according to any of Aspects 65 to 69, wherein release of the intracellular domain induces cell death by a mechanism other than apoptosis.

73. The method according to any of Aspects 65 to 69, wherein release of the intracellular domain modulates gene expression in the cell through transcriptional regulation, chromatin regulation, translation, trafficking or post-translational processing.

74. The method according to any of Aspects 65 to 69, wherein release of the intracellular domain modulates differentiation of the cell.

75. The method according to any of Aspects 65 to 69, wherein release of the intracellular domain modulates migration of the cell.

76. The method according to any of Aspects 65 to 69, wherein release of the intracellular domain modulates the expression and secretion of a molecule from the cell.

77. The method according to any of Aspects 65 to 69, wherein release of the intracellular domain modulates adhesion of the cell to a second cell or to an extracellular matrix.

78. The method according to any of Aspects 65 to 69, wherein release of the intracellular domain induces de novo expression or modulates expression of a gene product in the cell.

79. The method according to Aspect 78, wherein the gene product is a transcriptional activator, a transcriptional repressor, a chimeric antigen receptor, a second chimeric Notch receptor polypeptide, a translation regulator, a cytokine, a hormone, a chemokine, or an antibody.

80. A host cell comprising:
a) a nucleic acid encoding a chimeric polypeptide according to any of Aspects 29 to 58; and
b) a transcriptional control element responsive to the intracellular domain of the chimeric polypeptide operably linked to a nucleic acid encoding a polypeptide of interest (POI).

81. The host cell according to Aspect 80, wherein the host cell is genetically modified and the nucleic acid and the transcriptional control element are present within the genome of the host cell.

82. The host cell according to Aspect 80, wherein the nucleic acid and the transcriptional control element are present extrachromosomally within the host cell.

83. The host cell according to any of Aspects 80 to 82, wherein the POI is a heterologous polypeptide.

84. The host cell according to Aspect 83, wherein the heterologous polypeptide is selected from the group consisting of: a reporter protein, an immunoactivator, an immune suppression factor, a transcription factor, a site-specific nuclease, a recombinase, a chimeric antigen receptor (CAR), an antibody, a chimeric bispecific binding member, an engineered T cell receptor (TCR) an innate-immune response inducer.

85. The host cell according to any of Aspects 80 to 84, wherein the host cell is a eukaryotic cell.

86. The host cell according to Aspect 85, wherein the host cell is a mammalian cell.

87. The host cell according to Aspects 85 or 86, wherein the host cell is an immune cell, a neuron, an epithelial cell, and endothelial cell, or a stem cell.

88. The host cell according to Aspect 87, wherein the immune cell is a T cell, a B cell, a monocyte, a natural killer cell, a dendritic cell, a macrophage, a regulatory T cell, a helper T cell, or a cytotoxic T cell.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal (ly); s.c., subcutaneous(ly); and the like.

Example 1 vWF A2 Domain Substituted Notch Force Sensor Induces Notch Signaling

Both structural and biophysical studies indicate that the Notch S2 site is buried within the NRR and is exposed for cleavage by ligand binding to the amino-terminal EGF-repeat containing portion of Notch (Kovall et al., (2017) Dev. Cell 41:228-241). Concurrent studies argue for a change that is intrinsic to the NRR as a physical link between the ligand-bound, receptor ectodomain and the receptor transmembrane domain. Specifically, as posited in "pulling" models, the NRR could function as a force sensor that is unfolded by a threshold level of mechanical tension generated across the ligand/receptor bridge. If so, a heterologous force sensor that can be cleaved in response to a similar threshold of mechanical tension should be able to substitute for the NRR.

This was tested using the A2 domain of von Willibrand Factor (vWF), a well-characterized force sensor (see, e.g., Langridge & Struhl. Cell (2017) 171(6):1383-1396.e12, the disclosure of which is incorporated herein by reference in its entirety). The A2 domain requires a defined threshold of mechanical tension of ~8pN to render an otherwise hidden target site subject to cleavage by ADAM proteolysis (Tsai et al., (1994) Blood 83:2171-2179; Tsai, (1996) Blood 87:4235-4244.; Zhang et al., (2009) Science 324:1330-1334). This is significantly higher than the threshold of 3.5-5.4 pN for the NRR determined by comparable experiments (Gordon et al., (2015) Dev. Cell 33:729-736). However, several disease-related variants of the A2 domain have lower force thresholds in blood (Hassenpflug, (2006) Blood 107: 2339-2345; Xu and Springer, (2013) J. Biol. Chem. 288, 6317-6324) and kinetic analysis of one particular variant, R1597W, suggests that it is cleaved at a threshold that is ~2 pN lower than the wild type A2 domain (Xu and Springer, 2013), and similar to that of the NRR. However, even if the NRR functions, in vivo, as a force sensor, the capacity of the R1597W variant to substitute for it would also require that (i), Drosophila cells would have to have an endogenous protease, whether Kuz or some other, that can cleave the exposed A2 site, and (ii) the resulting cleaved form of the receptor would need to have a sufficiently small ectodomain stub to be subject to S3 cleavage by γ-secretase (Struhl and Adachi, (2000) Mol. Cell 6:625-636). Nevertheless, it has been found that some mutant forms of the A2 domain, including R1597W, can indeed function in place of NRR to recapitulate Epsin-dependent FSHD1/FSHR-N signaling, indicating that these requirements are met.

To investigate these mechanisms of Delta (D1)/Notch cell-cell signaling in developing drosophila wing disks, such a heterologous force sensor was produced. Specifically, the wild-type Notch regulator region (NRR) of the *Drosophila* Notch receptor was replaced with a wild-type form of the von Willebrand Factor (vWF) A2 domain (FIG. 1A), which is cleaved by a protease in response to tensile force applied across the domain. In addition, to bypass certain requirements of D1/Notch interaction, the native ligand interaction domain of Notch was replaced with the ligand binding domain of follicle stimulating hormone receptor (FSHR). The FSH-D1/FSHR-N pair recapitulates native DSL/Notch signaling independent of endogenous DSL ligands.

As schematized in FIG. 1A, the resulting chimeric polypeptide included a Notch intracellular domain (NICD) (100), a Notch transmembrane domain (101), the wild-type vWF A2 domain (102) and the FSHR domain (103). Corresponding chimeric polypeptides were also produced using disease associated forms of the vWF A2 domain, which are cleaved at different force thresholds, as schematized in FIG. 1B. A detailed schematic of a vWF A2 domain substituted FSH/FSHR Notch receptor, showing domain boundaries, is provided in FIG. 1C.

Figure 2A:
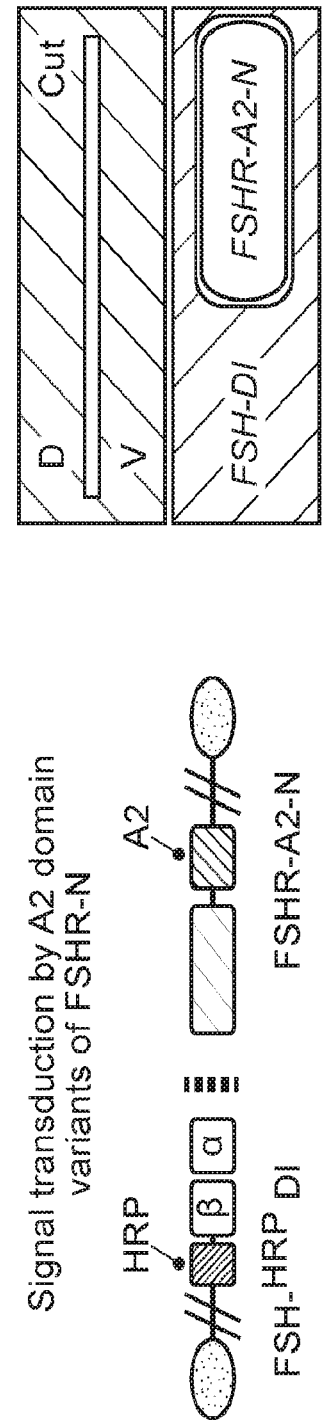

The capacity of the A2 domain to substitute for the NRR was first tested by using MAPS (see description below) to test the capacity of FSHR-A2$^{WT}$-N, a form of the receptor that contains the wild type A2 domain in place of the NRR, to respond to FSH-D1. However, evidence for signaling, as monitored by the capacity of UAS>FSH-D1 cells to induce of ectopic Cut expression in abutting UAS>FSHR-A2$^{WT}$-N cells was not detected, even when the UAS>FSH-D1 and UAS>FSHR-A2$^{WT}$-N transgenes were homozygous and the experiment performed at 29° C.—both conditions that should optimize expression of the two proteins (FIG. 2A-2B).

Next an R1597W version of the receptor, FSHR-A2$^{R1597W}$-N, was tested using the same optimized conditions as for FSHR-A2$^{WT}$-N, and a positive result was obtained, ectopic expression of Cut (FIG. 2C). The response was confined to FSHR-A2$^{R1597W}$-N expressing cells within 5-10 cell diameters of the D/V compartment boundary, rather than within 10-20 cell diameters, as observed for FSHR-N. This more restricted response could reflect less efficient S2 or S3 cleavage, as noted above, and/or a modest difference in the tuning of the R1597W A2 domain relative to the native NRR.

Further corroborating this result, two other disease variants of the A2 domain, E1638K and I1628T, that result in similarly elevated levels of proteolysis in blood (Hassenpflug, 2006), and hence are likely cleaved in response to a similar force threshold, behaved like the R1597W variant when used in place of the NRR (FIG. 2C). Importantly, all three of these A2 variant receptors failed to respond to version of ligand unable to enter the Epsin pathway (FSH-D1-K>R) (FIG. 2C), or when FSHa was not expressed (as shown for FSHR-A2$^{E1638K}$-N; FIG. 2D). Thus, all three of these A2 variant receptors respond in a manner that depends on ligand binding, and more particularly, on entry of ligand into the Epsin pathway.

Finally, a fourth mutant form of the FSHR-A2-N receptor, M1528V, was tested. This form is associated with a markedly weaker effect on vWF cleavage in blood than the first three, and hence appears to be tuned to a higher force threshold (Hassenpflug, Blood (2006) 107(6):2339-45). The resulting FSHR-A2$^{M1528V}$-N receptor, like the wildtype FSHR-A2-N receptor, appears refractory to signaling by FSH-D1 (FIG. 2B), reinforcing the correlation between the force necessary to render the different forms of the A2 domain subject to proteolysis in blood and their capacity to function in place of the NRR.

It is concluded that Epsin-dependent ligand endocytosis is required to exert a specific level of force on the receptor that is sufficient to render the first three mutant A2 domains—but neither the M1528V mutant domain nor the wild type domain—subject to an S2-like cleavage in the particular context evaluated. Thus, in the context of Epsin-dependent ligand endocytosis, in vivo evidence is provided that the endocytosis exerts a distinct level of mechanical tension on the intercellular ligand/receptor bridge, and that the NRR need only function as an equivalent force sensor to the R1597W, E1638K and I1628T mutant A2 domains to mediate activation of the receptor by ligand.

This example provides positive evidence for Notch pulling models by showing that the A2 domain from von Willibrand Factor—a bona-fide force sensor (Tsai et al., Blood (1996) 87:4235-4244; Zhang et al., Science (2009) 324:1330-1334)—can substitute for the NRR in mediating Epsin-dependent activation of a canonical FSHR-N chimera.

Signaling was only observed when disease-related A2 variants that are more readily cleaved in blood than the wildtype domain were employed, correlating with biophysical data that such variant domains, as well as the native NRR, are tuned to a lower force threshold that is comparable to that of native D1/Notch in biophysical studies (Hassenpflug, 2006; Xu and Springer, J. Biol. Chem (2013) 288: 6317-6324; Gordon et al., Dev. Cell (2015) 33:729-736). These results indicate that Epsin-mediated endocytosis of ligand exerts a distinct level of mechanical tension on the ligand/receptor bridge that is both necessary and sufficient to induce S2 cleavage in vivo.

Mosaic Analysis by Promoter Swap (MAPS)

A genetic strategy termed Mosaic Analysis by Promoter Swap (MAPS) was utilized to subdivide the developing wing epithelium into mutually exclusive subpopulations of chimeric ligand and receptor expressing cells, such that ligand and receptor interact only in trans wherever the two subpopulations abut. This approach is schematized in FIG. 3A.

FIG. 3A: Flp/FRT mediated mitotic recombination ("X") in ligand expressing, transheterozygous UAS>ligand/Ø>receptor mother cells ("Ligand") yields ligand and receptor expressing daughter cells ("Ligand" and "Receptor", respectively) subdividing the wing primordium into mutually exclusive subpopulations of dedicated ligand ("Ligand") and receptor ("Receptor") expressing cells. For a color version of this or other figures of this example, refer to Langridge & Struhl. Cell (2017) 171(6):1383-1396.e12, the disclosure of which is incorporated herein by reference in its entirety.

In essence, heat shock induced, Flp/FRT-mediated mitotic recombination (Golic (1991) Science 252:958-961) was used to generate clones of cells that express one of the two proteins (e.g., the receptor) in a background of cells that express the other (e.g., the ligand). This strategy relies on (i) transgenes that are inserted at the same genomic docking site (Groth et al., (2004) Genetics 166:1775-1782) and contain a single Flp Recombinase Target site (FRT; ">") immediately upstream of the ligand and receptor coding sequences, and (ii) the use of a Gal4 responsive promoter WAS; (Brand and Perrimon, (1993) Development 118:401-415] in front of the ligand coding sequence and the absence of a functional promoter (Ø) in front of the receptor coding sequence. Heterozygous UAS>ligand/Ø>receptor cells express only the ligand; however, as depicted in FIG. 3A, Flp-mediated mitotic recombination generates two daughter cells, one of which now expresses only the receptor whilst the other continues to express only the ligand. The resulting, mutually exclusive subpopulations of receptor and ligand expressing cells are distinguished by epitope tagging either the ligand or receptor. Finally, nubbin.Gal4 (nub.Gal4) or rotund.Gal4 (rn.Gal4) transgenes were used to drive UAS promoter activity in the prospective wing, where peak Notch activation is normally restricted to a thin stripe of "border" cells flanking the dorsoventral (D/V) compartment boundary [reviewed in (Blair, (1997) Curr. Biol. 7:R686-R690); FIG. 3B]: this allows signaling between UAS>ligand and UAS>receptor cells to be assayed by assaying for ectopic expression of Notch target genes, such as cut or wingless (wg) (FIG. 3C, FIG. 3D).

FIG. 3B: The wing primordium comprises a circular domain of cells that express the nub.Gal4 transgene (as indicated) within the wing imaginal disc, which is subdivided into dorsal (D) and ventral (V) compartments (the D/V boundary is shown in black; the middle panel shows expression of an HRP-tagged form of D1 under nub.Gal4 control (as in FIG. 3C-3E). D cells express the DSL ligand Serrate as well as a glycosyl-transferase Fringe, whereas V cells express the DSL ligand Delta. Fringe biases Notch to respond to Delta whereas the absence of Fringe biases Notch to respond to Serrate, resulting in the induction of Notch target genes (e.g., cut, yellow) on both sides of the boundary. Here and in the remaining figures of this example, UAS transgenes are expressed under nub.Gal4 (or similarly m. Gal4) control, and only the epitope tags relevant to the experiment are shown in the cartoons of ligand and receptor structure.

FIG. 3C: UAS>Delta cells (gray) induce ectopic Cut (white) in abutting UAS>Notch cells (black) in the D but not the V compartment; coexpression of Neuralized, which boost recruitment of ligand to the Epsin pathway, overcomes the Fringe-dependent bias and results in ectopic Cut expression in both compartments.

FIG. 3D: FSH-D1/FSHR-N signaling induces ectopic Cut expression in both compartment, up to ~10-20 cell diameters from the D/V boundary in wildtype discs, and up to ~30 or more cell diameters in Neur coexpressing discs.

Example 2

Antigen-Specific Expression Controlled by a vWF Cleavage Domain-Containing Chimeric Polypeptide Despite observing signaling in the specific contexts of Example 1 only when disease-related A2 variants were employed, the prior example nonetheless indicates that various vWF A2 domains, including the wild-type domain, may serve as a binding/force-sensitive cleavage domain in chimeric polypeptides in other contexts.

Chimeric polypeptides were designed to test the use of a vWF cleavage domain for binding-induced proteolytic release of a desired intracellular domain. Various constructs having either mouse or human wild-type vWF A2 domains were designed and tested. Examples of designed and tested constructs are as follows:

P272: anti-CD19 mm_VWFA2_Notch1extendedcyto Ga14VP64 (FIG. 4A);

P273: anti-CD19 hs_VWFA2_Notch1extendedcyto Ga14VP64 (FIG. 4B);

P289: anti-CD19 mm_VWFA2_Notch1 uptoS2ECtoCoreCyto Ga14VP64 (FIG. 4C);

P290: anti-CD19 mm_VWFA2_Notch1 shorterECtoCoreCyto Ga14VP64 (FIG. 4D);

P319: anti-CD19 mm_VWFA2_Notch1 shorterECtoextended cyto Ga14VP64 (FIG. 4E); and P320: anti-CD19 mm_VWFA2_Notch1 Ga14VP64 (FIG. 4F).

The amino acid sequences of these constructs, and the corresponding vector from which each chimeric polypeptide is encoded, are provided below:

```
P272 pHR_pGK_CD19scFv_mm_VWFA2_Notch1extendedcyto_Gal4VP64,
encoding:
                                                (SEQ ID NO: 234)
MALPVTALLLPLALLLHAARPEQKLISEEDLDIQMTQTTSSLSASLGDRVTISCRASQDISKYLN

WYQQKPDGTVKLLIYHTSRLHSGVPSRFSGSGSGTDYSLTISNLEQEDIATYFCQQGNTLPYTFG

GGTKLEITGGGGSGGGGSGGGGSEVKLQESGPGLVAPSQSLSVTCTVSGVSLPDYGVSWIRQPP

RKGLEWLGVIWGSETTYYNSALKSRLTIIKDNSKSQVFLKMNSLQTDDTAIYYCAKHYYYGGS

YAMDYWGQGTSVTVSSPGIAGISSPGPKRKSMVLDVVFVLEGSDEVGEANFNKSKEFVEEVIQR

MDVSPDATRISVLQYSYTVTMEYAFNGAQSKEEVLRHVREIRYQGGNRTNTGQALQYLSEHSF

SPSQGDRVEAPNLVYMVTGNPASDEIKRLPGDIQVVPIGVGPHANMQELERISRPIAPIFIRDFE

TLPREAPDLVLQTCCSKEGLQLPLMYVAAAAFVLLFFVGCGVLLSRKRRRQHGQLWFPEGFKVSE

ASKKKRREPLGMKLLSSIEQACDICRLKKLKCSKEKPKCAKCLKNNWECRYSPKTKRSPLTRAH

LTEVESRLERLEQLFLLIFPREDLDMILKMDSLQDIKALLTGLFVQDNVNKDAVTDRLASVETD

MPLTLRQHRISATSSSEESSNKGQRQLTVSAAAGGSGGSGGSDALDDFDLDMLGSDALDDFDL

DMLGSDALDDFDLDMLGSDALDDFDLDMLGS;
```

P273 pHR_pGK_CD19scFv_hs_VWFA2_Notch1extendedcyto_Gal4VP64 (1),
encoding:

(SEQ ID NO: 235)
MALPVTALLLPLALLLHAARPEQKLISEEDLDIQMTQTTSSLSASLGDRVTISCRASQDISKYLN

WYQQKPDGTVKLLIYHTSRLHSGVPSRFSGSGSGTDYSLTISNLEQEDIATYFCQQGNTLPYTFG

GGTKLEITGGGSGGGGSGGGGSEVKLQESGPGLVAPSQSLSVTCTVSGVSLPDYGVSWIRQPP

RKGLEWLGVIWGSETTYYNSALKSRLTIIKDNSKSQVFLKMNSLQTDDTAIYYCAKHYYYGGS

YAMDYWGQGTSVTVSSPGLLGVSTLGPKRNSMVLDVAFVLEGSDKIGEADFNRSKEFMEEVIQ

RMDVGQDSIHVTVLQYSYMVTVEYPFSEAQSKGDILQRVREIRYQGGNRTNTGLALRYLSDHS

FLVSQGDREQAPNLVYMVTGNPASDEIKRLPGDIQVVPIGVGPNANVQELERIGWPNAPILIQDF

ETLPREAPDLVLQRCCSGEGLQIPFMYVAAAAFVLLFFVGCGVLLSRKRRRQHGQLWFPEGFKV

SEASKKKRREPLGMKLLSSIEQACDICRLKKLKCSKEKPKCAKCLKNNWECRYSPKTKRSPLTR

AHLTEVESRLERLEQLFLLIFPREDLDMILKMDSLQDIKALLTGLFVQDNVNKDAVTDRLASVET

DMPLTLRQHRISATSSSEESSNKGQRQLTVSAAAGGSGGSGGSDALDDFDLDMLGSDALDDFD

LDMLGSDALDDFDLDMLGSDALDDFDLDMLGS;

p289 pHR_pGK_CD19scFv_mm_VWFA2_Notch1_uptoS2ECtoCoreCyto_Gal4VP64,
endcoding:

(SEQ ID NO: 236)
MALPVTALLLPLALLLHAARPEQKLISEEDLDIQMTQTTSSLSASLGDRVTISCRASQDISKYLN

WYQQKPDGTVKLLIYHTSRLHSGVPSRFSGSGSGTDYSLTISNLEQEDIATYFCQQGNTLPYTFG

GGTKLEITGGGSGGGGSGGGGSEVKLQESGPGLVAPSQSLSVTCTVSGVSLPDYGVSWIRQPP

RKGLEWLGVIWGSETTYYNSALKSRLTIIKDNSKSQVFLKMNSLQTDDTAIYYCAKHYYYGGS

YAMDYWGQGTSVTVSSPGIAGISSPGPKRKSMVLDVVFVLEGSDEVGEANFNKSKEFVEEVIQR

MDVSPDATRISVLQYSYTVTMEYAFNGAQSKEEVLRHVREIRYQGGNRTNTGQALQYLSEHSF

SPSQGDRVEAPNLVYMVTGNPASDEIKRLPGDIQVVPIGVGPHANMQELERISRPIAPIFIRDFET

LPREAPDLVLQTCCSKEGLQLPKSEPVEPPLPSQLHLMYVAAAAFVLLFFVGCGVLLSRKRRRMK

LLSSIEQACDICRLKKLKCSKEKPKCAKCLKNNWECRYSPKTKRSPLTRAHLTEVESRLERLEQL

FLLIFPREDLDMILKMDSLQDIKALLTGLFVQDNVNKDAVTDRLASVETDMPLTLRQHRISATSS

SEESSNKGQRQLTVSAAAGGSGGSGGSDALDDFDLDMLGSDALDDFDLDMLGSDALDDFDLD

MLGSDALDDFDLDMLGS;
and p290 pHR_pGK_CD19scFv_mm_VWFA2_Notch1_shorterEXtoCoreCyto_Gal4VP64,
encoding:

(SEQ ID NO: 237)
MALPVTALLLPLALLLHAARPEQKLISEEDLDIQMTQTTSSLSASLGDRVTISCRASQDISKYLN

WYQQKPDGTVKLLIYHTSRLHSGVPSRFSGSGSGTDYSLTISNLEQEDIATYFCQQGNTLPYTFG

GGTKLEITGGGSGGGGSGGGGSEVKLQESGPGLVAPSQSLSVTCTVSGVSLPDYGVSWIRQPP

RKGLEWLGVIWGSETTYYNSALKSRLTIIKDNSKSQVFLKMNSLQTDDTAIYYCAKHYYYGGS

YAMDYWGQGTSVTVSSPGIAGISSPGPKRKSMVLDVVFVLEGSDEVGEANFNKSKEFVEEVIQR

MDVSPDATRISVLQYSYTVTMEYAFNGAQSKEEVLRHVREIRYQGGNRTNTGQALQYLSEHSF

SPSQGDRVEAPNLVYMVTGNPASDEIKRLPGDIQVVPIGVGPHANMQELERISRPIAPIFIRDFET

LPREAPDLVLQTCCSKEGLQLPSQLHLMYVAAAAFVLLFFVGCGVLLSRKRRRMKLLSSIEQACD

ICRLKKLKCSKEKPKCAKCLKNNWECRYSPKTKRSPLTRAHLTEVESRLERLEQLFLLIFPREDL

-continued

```
DMILKMDSLQDIKALLTGLFVQDNVNKDAVTDRLASVETDMPLTLRQHRISATSSSEESSNKGQ

RQLTVSAAAGGSGGSGGSDALDDFDLDMLGSDALDDFDLDMLGSDALDDFDLDMLGSDALD

DFDLDMLGS.

p319 pHR_pGK_CD19scFv_mm_VWFA2_Notch1_S2shorterEC_TMtoNLS_Gal4VP64,
encoding:
                                                    (SEQ ID NO: 491)
MALPVTALLLPLALLLHAARPEQKLISEEDLDIQMTQTTSSLSASLGDRVTISCRASQDISKYLN

WYQQKPDGTVKLLIYHTSRLHSGVPSRFSGSGSGTDYSLTISNLEQEDIATYFCQQGNTLPYTFG

GGTKLEITGGGGSGGGGSGGGGSEVKLQESGPGLVAPSQSLSVTCTVSGVSLPDYGVSWIRQPP

RKGLEWLGVIWGSETTYYNSALKSRLTIIKDNSKSQVFLKMNSLQTDDTAIYYCAKHYYYGGS

YAMDYWGQGTSVTVSSPGIAGISSPGPKRKSMVLDVVFVLEGSDEVGEANFNKSKEFVEEVIQR

MDVSPDATRISVLQYSYTVTMEYAFNGAQSKEEVLRHVREIRYQGGNRTNTGQALQYLSEHSF

SPSQGDRVEAPNLVYMVTGNPASDEIKRLPGDIQVVPIGVGPHANMQELERISRPIAPIFIRDFE

TLPREAPDLVLQTCCSKEGLQLPSQLHLMYVAAAAFVLLFFVGCGVLLSRKRRRQHGQLWFPEGF

KVSEASKKKRREPLGMKLLSSIEQACDICRLKKLKCSKEKPKCAKCLKNNWECRYSPKTKRSPL

TRAHLTEVESRLERLEQLFLLIFPREDLDMILKMDSLQDIKALLTGLFVQDNVNKDAVTDRLAS

VETDMPLTLRQHRISATSSSEESSNKGQRQLTVSAAAGGSGGSGGSDALDDFDLDMLGSDALD

DFDLDMLGSDALDDFDLDMLGSDALDDFDLDMLGS.

p320 pHR_pGK_CD19scFv_mm_VWFA2_Notch1_OriginialNotch_Gal4VP64,
encoding:
                                                    (SEQ ID NO: 492)
MALPVTALLLPLALLLHAARPEQKLISEEDLDIQMTQTTSSLSASLGDRVTISCRASQDISKYLN

WYQQKPDGTVKLLIYHTSRLHSGVPSRFSGSGSGTDYSLTISNLEQEDIATYFCQQGNTLPYTFG

GGTKLEITGGGGSGGGGSGGGGSEVKLQESGPGLVAPSQSLSVTCTVSGVSLPDYGVSWIRQPP

RKGLEWLGVIWGSETTYYNSALKSRLTIIKDNSKSQVFLKMNSLQTDDTAIYYCAKHYYYGGS

YAMDYWGQGTSVTVSSPGIAGISSPGPKRKSMVLDVVFVLEGSDEVGEANFNKSKEFVEEVIQR

MDVSPDATRISVLQYSYTVTMEYAFNGAQSKEEVLRHVREIRYQGGNRTNTGQALQYLSEHSF

SPSQGDRVEAPNLVYMVTGNPASDEIKRLPGDIQVVPIGVGPHANMQELERISRPIAPIFIRDFET

LPREAPDLVLQTCCSKEGLQLPLMYVAAAAFVLLFFVGCGVLLSRKRRRMKLLSSIEQACDICRL

KKLKCSKEKPKCAKCLKNNWECRYSPKTKRSPLTRAHLTEVESRLERLEQLFLLIFPREDLDMIL

KMDSLQDIKALLTGLFVQDNVNKDAVTDRLASVETDMPLTLRQHRISATSSSEESSNKGQRQLT

VSAAAGGSGGSGGSDALDDFDLDMLGSDALDDFDLDMLGSDALDDFDLDMLGSDALDDFDL

DMLGS.
```

As can be seen in the above, the chimeric polypeptides of this example included Notch receptor transmembrane domains and various different portions of the Notch receptor, including extracellular portions, cytoplasmic portions or both. The Notch receptor boundary positions corresponding to UniProt ID P46531 (human, SEQ ID NO:238) or Q01705 (mouse, SEQ ID NO:239) are provided in the schematics of FIG. 4A-4F. Corresponding positions in other Notch polypeptide sequences, e.g., from other species or variant sequences, can be readily located by an ordinarily skilled artisan, e.g., through the use of pair-wise or multiple sequence alignments. The vWF protein boundary positions corresponding to UniProt ID P04275 (human, SEQ ID NO:73) or Q8CIZ8 (mouse, SEQ ID NO:71) are also provided in the schematics of FIG. 4A-4F. All constructs included an extracellular domain that includes an anti-CD19 scFv and an intracellular domain that includes a Gal4VP64 transcriptional activator.

Figure 5:
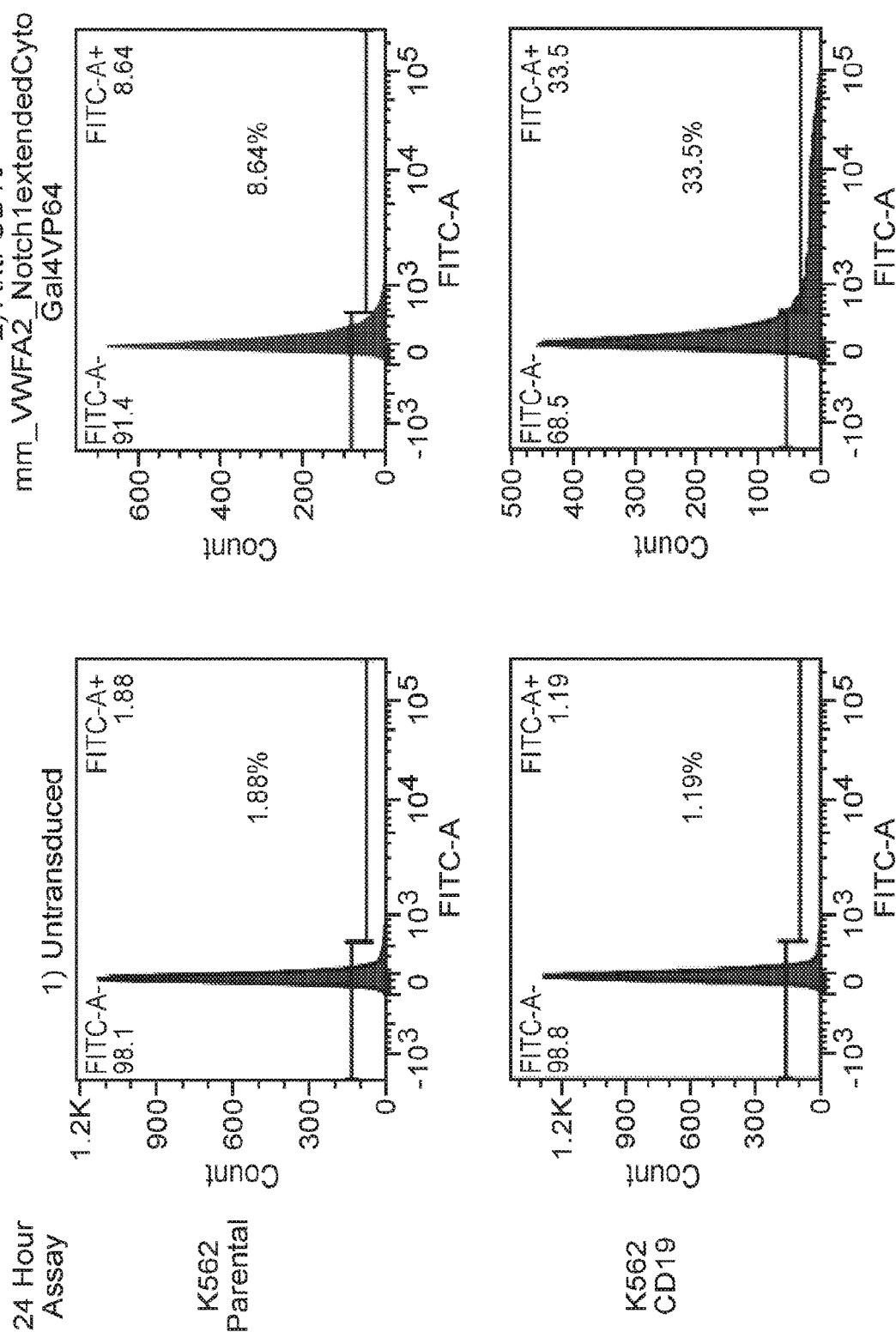
FIG. 5 demonstrates antigen-specific response element activation by cells expressing chimeric polypeptides containing murine vWF force sensor cleavage domains and Notch domains as schematized in FIG. 4A, FIG. 4C and FIG. 4D in a 24 hour assay.
Figure 5:
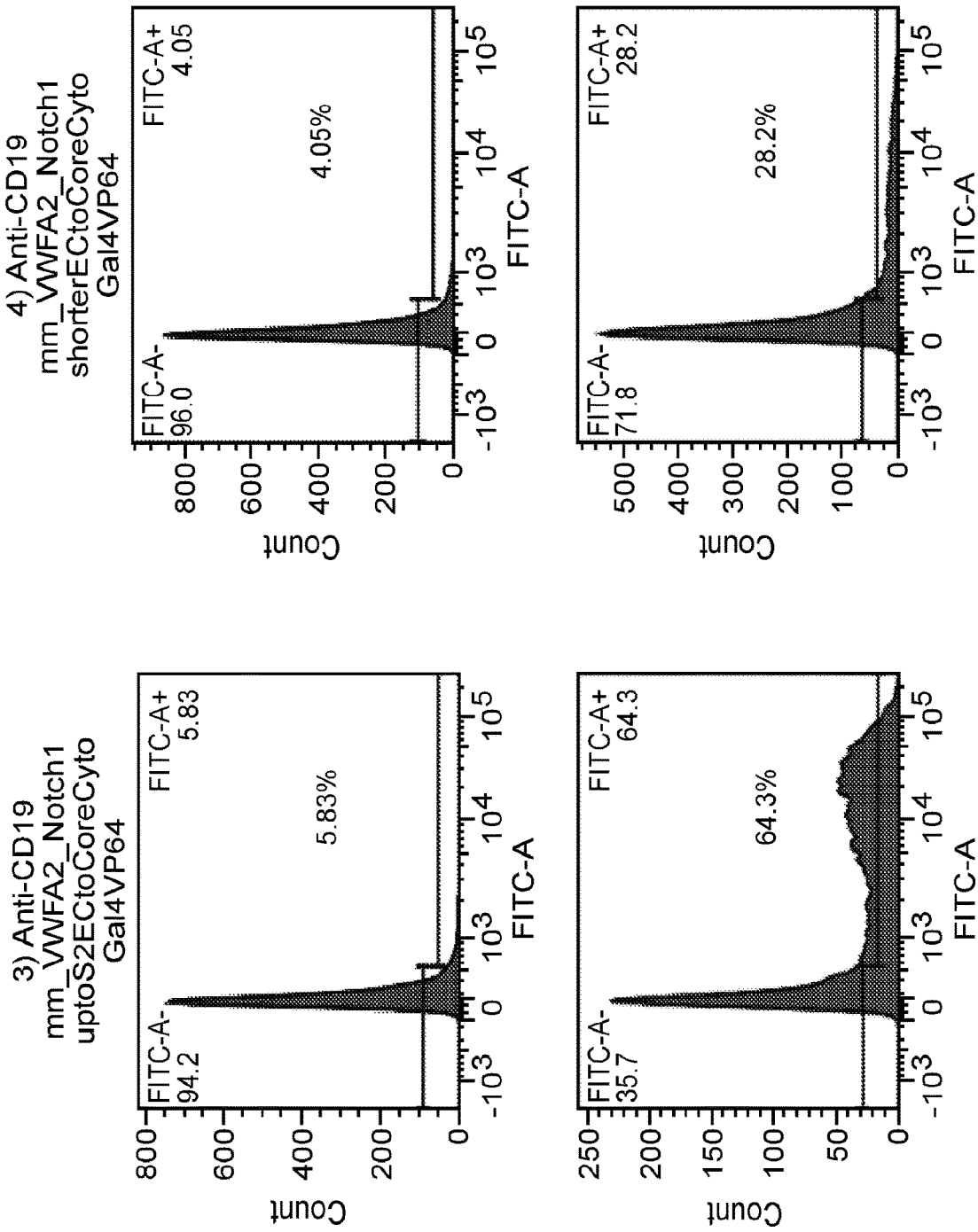
Figure 8:
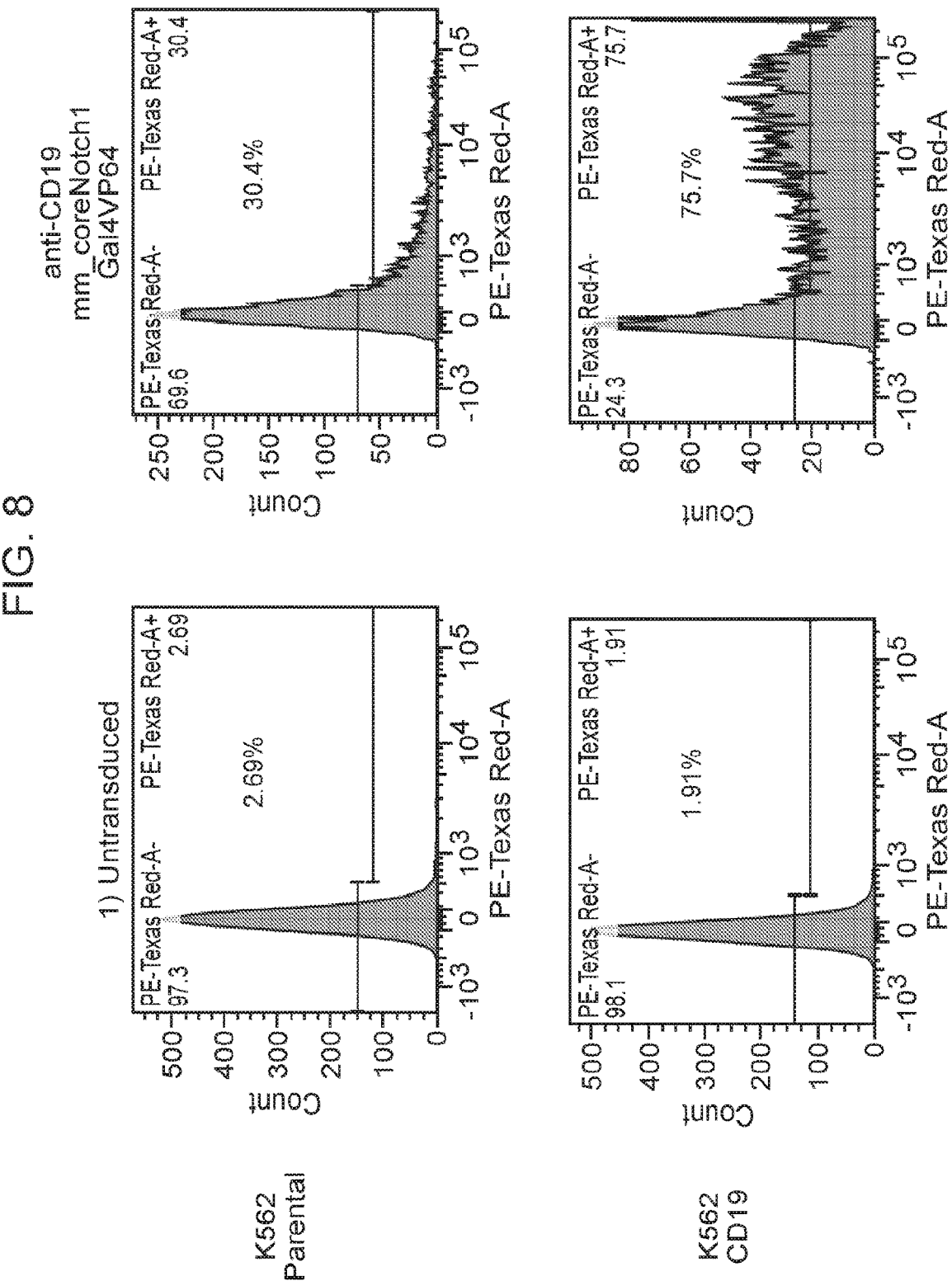
FIG. 8 demonstrates antigen-specific response element activation by cells expressing chimeric polypeptides containing vWF force sensor cleavage domains and Notch domains as schematized in FIG. 4A and FIG. 4C-4F, and a chimeric Notch receptor as schematized in FIG. 7, in a 72 hour assay.
Figure 8:
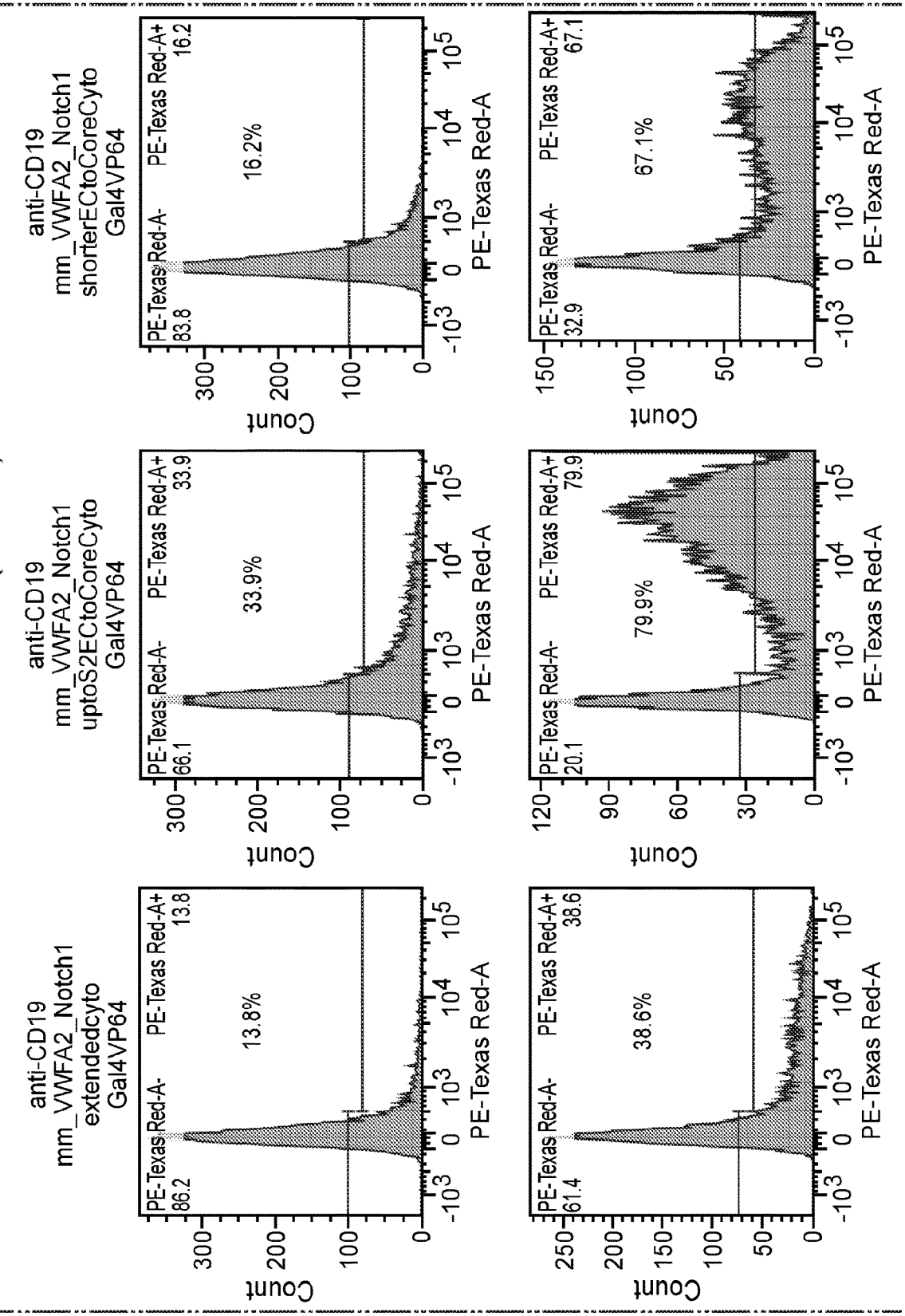
Figure 8:
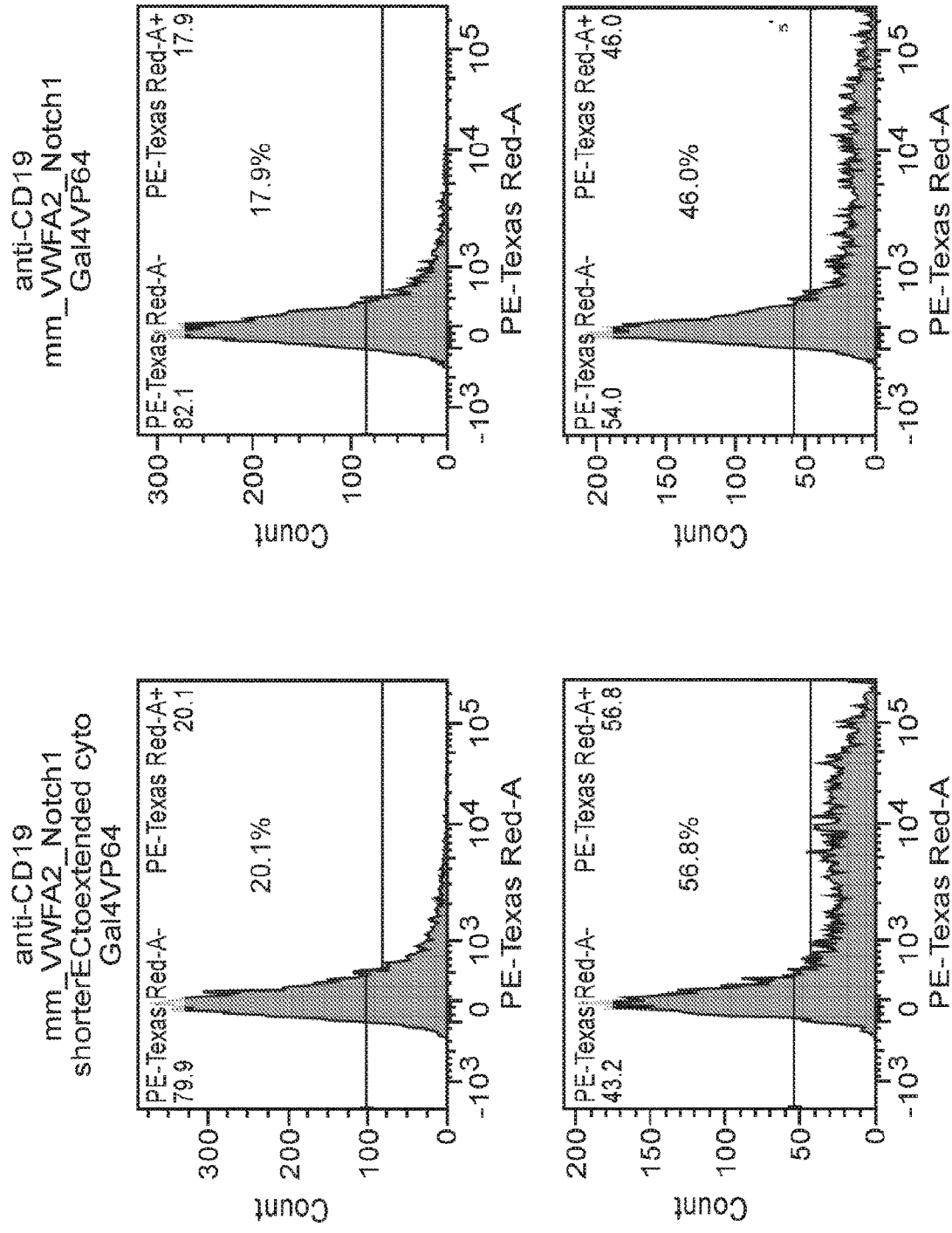

The constructs containing murine vWF ortholog and murine Notch ortholog portions (e.g., P272, P289 and P290) were tested in primary CD8 T cells for their ability to induce expression from a co-transduced response element (Gal4UAS GFP pGK tBFP) in response to K562 cells presenting the cognate antigen for the chimeric receptors (i.e., CD19). Reporter expression (i.e., fluorescent protein expression) was measured by flow cytometry. Antigen-specific reporter expression was seen in all constructs, as shown in FIG. 5 and FIG. 8. Specifically, as depicted in the top panels of FIG. 5, specific response element activation was not seen when the transduced CD8 T cells were contacted with target cells that do not express the cognate antigen (i.e., "K562 Parental"). However, as depicted in the bottom panels of FIG. 5, in the presence of CD19+ target cells (i.e., "K562 CD19") the response element was activated, resulting in increased numbers of CD8 T cells expressing the reporter. The displayed percentages provide percent response element activation and the "untransduced" data is provided as a negative control.

Figure 6:
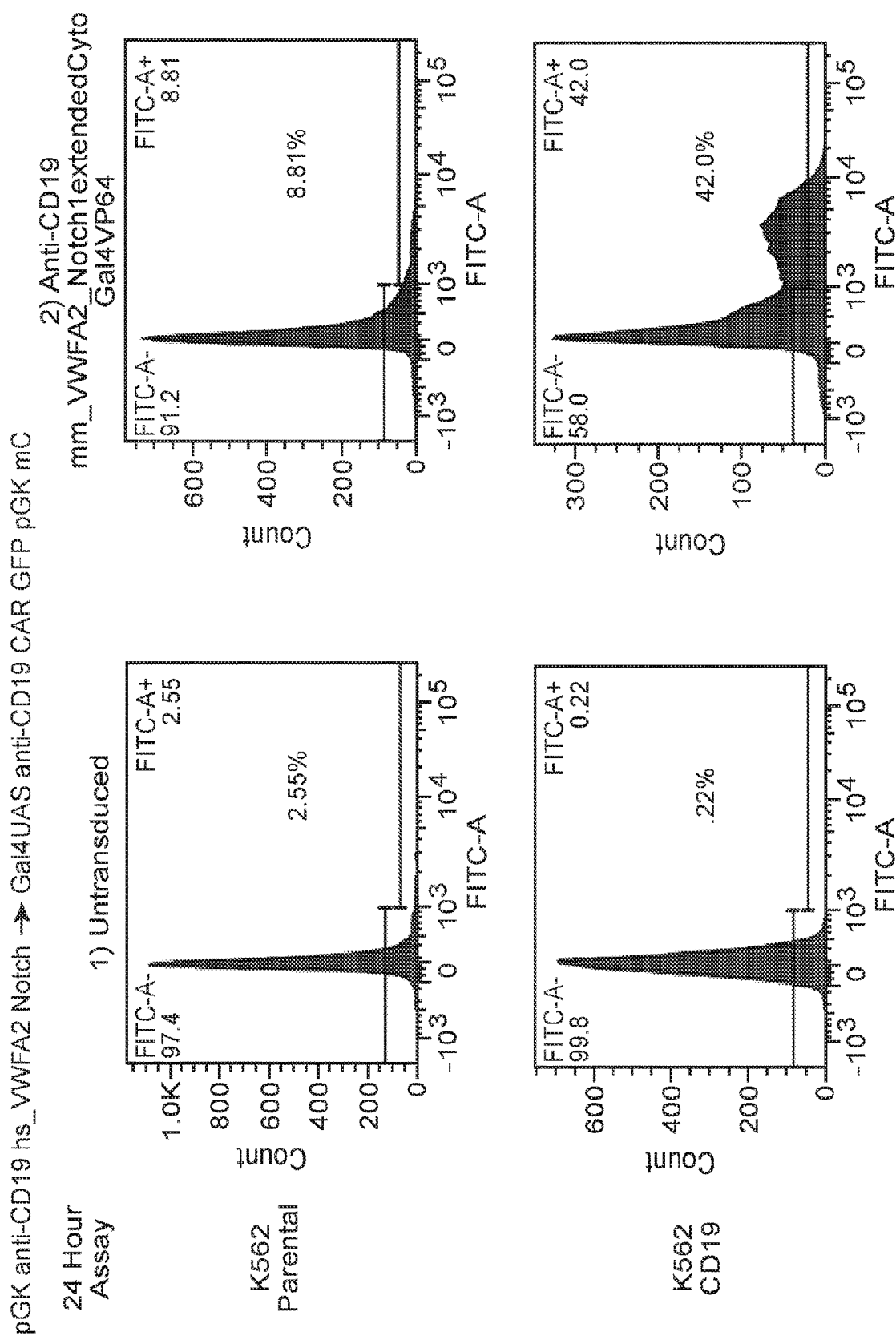
FIG. 6 demonstrates antigen-specific response element activation by cells expressing chimeric polypeptides containing human vWF force sensor cleavage domains and Notch domains as schematized in FIG. 4B in a 24 hour assay.

The construct containing human vWF ortholog and human Notch ortholog portions (i.e., P273) was tested in primary CD8 T cells for its ability to induce expression from a co-transduced response element (Ga14UAS anti-CD19 CAR GFP pGK mC) in response to K562 cells presenting the cognate antigen for the chimeric receptor (i.e., CD19). As above, reporter expression (i.e., fluorescent protein expression) was measured by flow cytometry. As shown in FIG. 6, antigen-specific reporter expression was seen using this construct. Specifically, as depicted in the top panels of FIG. 6, specific response element activation was not seen when the transduced CD8 T cells were contacted with target cells that do not express the cognate antigen (i.e., "K562 Parental"). However, as depicted in the bottom panels of FIG. 6, in the presence of CD19+ target cells (i.e., "K562 CD19") the response element was activated, resulting in increased numbers of CD8 T cells expressing the reporter. The displayed percentages provide percent response element activation and the "untransduced" data is provided as a negative control.

These examples demonstrate that chimeric polypeptides containing a vWF cleavable domain, including wild-type domains derived from human and mouse, are effectively and specifically activated (i.e., cleaved) in response to the presence of cells expressing the antigen for the chimeric polypeptides. These examples show that such chimeric polypeptides may be used to modulate (e.g., activate) transcription from an introduced response element, in this case resulting in expression of a heterologous protein in an antigen-specific manner.

Figure 7:
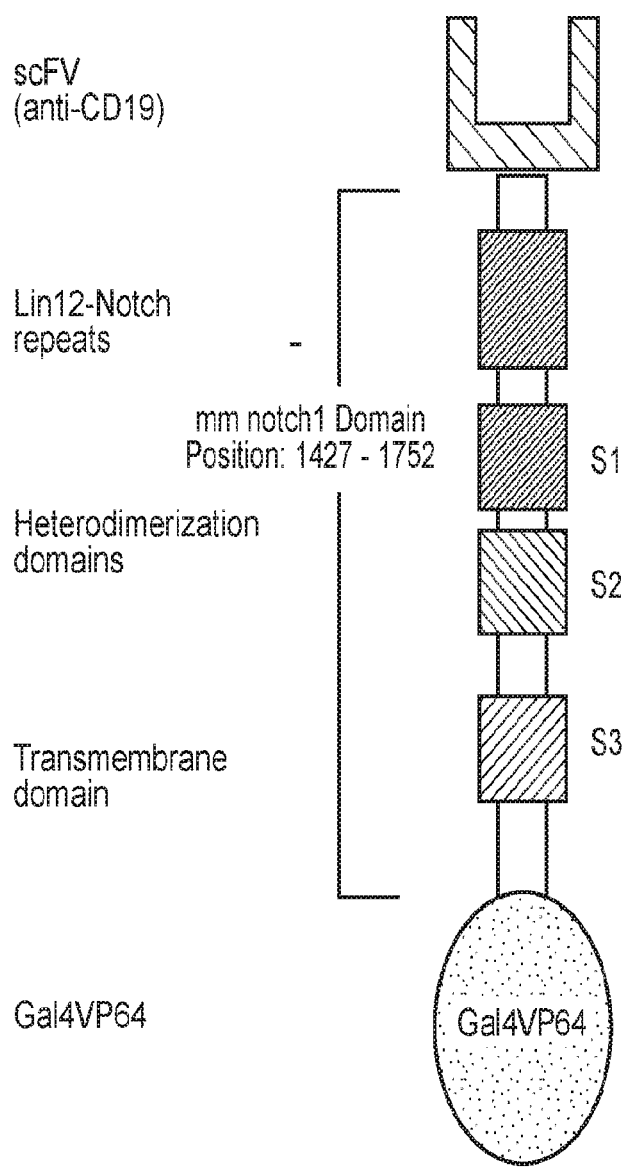
FIG. 7 provides a schematic depiction of a chimeric Notch receptor polypeptide, referred to herein as anti-CD19 mm_coreNotch1 Gal4VP64 (or P8).

Antigen-specific response element activation in cells expressing chimeric polypeptides having vWF force sensor cleavage domains was compared to antigen-specific response element activation in cells expressing a chimeric Notch receptor (i.e., a chimeric receptor having a Notch cleavage domain) Specifically, the vWF force sensor cleavage domain and Notch domain containing polypeptides as schematized in FIG. 4A and FIG. 4C-4F were compared (in the presence of cells expressing ("K562 CD19") and not expressing ("K562 Parental") CD19 antigen) to the chimeric Notch receptor polypeptide as schematized in FIG. 7 (anti-CD19 mm_coreNotch1 Ga14VP64, also referred to as "P8").

Figure 9:
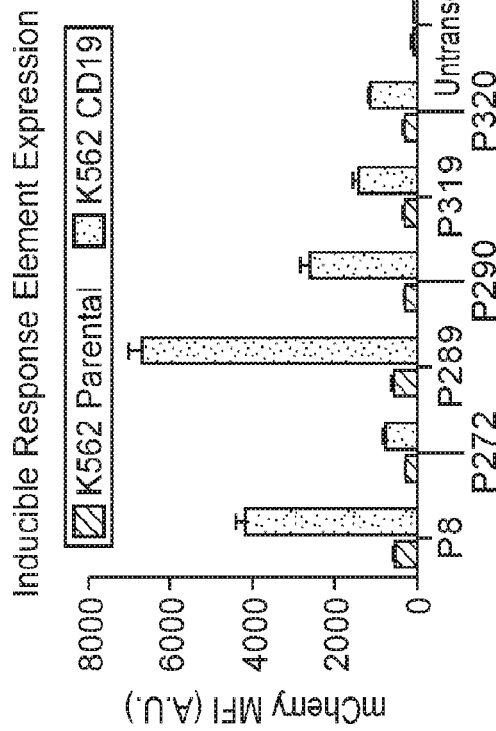
FIG. 9 provides quantification related to the results provided in FIG. 8.
Figure 10:
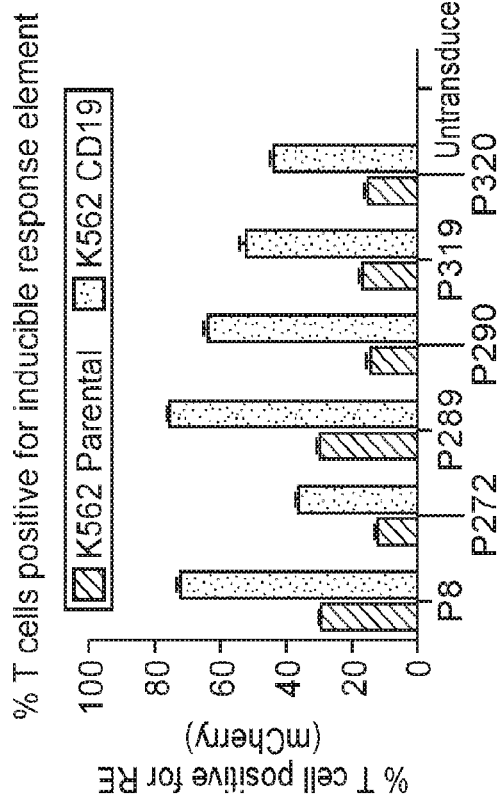
FIG. 10 shows the expression levels of various different chimeric receptors for which antigen-specific response element activation is provided in FIG. 8 and quantified in FIG. 9.

As shown in FIG. 8, all tested constructs demonstrated antigen-specific response element activation, the level of which varied between constructs. Quantification of the percent of T cells positive for the inducible response element and the level of indicible response element expression is provided in FIG. 9. Notably, induced response element expression seen in the presence of CD19 expressing K562 cells using the vWF force sensor cleavage domain and Notch domain containing polypeptides was comparable to, and in some instances higher than (see e.g., P289), induced response element expression due to the chimieric Notch receptor polypeptide reference employing a Notch cleavage domain (P8). That such induced expression was seen eventhough the vWF force sensor cleavage domain polypeptides were expressed at levels considerably below that of P8 (see FIG. 10) indicates the effectiveness of vWF force sensor cleavage domain-containing chimeric receptors.

Figure 11:
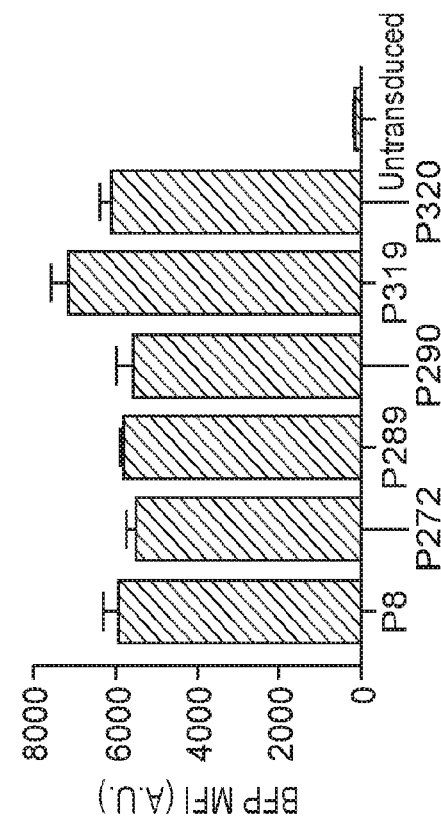
FIG. 11 provides a control showing that response element constructs are expressed at similar levels between the different constructs evaluated in FIG. 8-10.

FIG. 11 is a control, showing that the response element genes were expressed at similar levels between the different constructs. Thus, observed differences in response element activation were not due to differences in the availability of the response element reporter construct.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (492 sequences)

SEQ ID NO: 1 - protein, 2555 aa, Homo sapiens
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 2 - protein, 2531 aa, mus musculus
MPRLLTPLLCLTLLPALAARGLRCSQPSGTCLNGGRCEVANGTEACVCSGAFVGQRCQDSNPCLSTPCKNAGTCHVVDHGGTVDYACSCPLGFSGPLCLTPLDNACLANPCRNGGTCDLLTLTEYKCRCPPGWSGKSCQQADPCASNPCANGGQCLPFESSYICRCPPGFHGPTCRQDVNECSQNPGLCRHGGTCHNEIGSYRCACRATHTGPHCELPYVPCSPSPCQNGGTCRPTGDTTHECACLPGFAGQNCEENVDDCPGNNCKNGGACVDGVNTYNCRCPPEWTGQYCTEDVDECQLMPNACQNGGTCHNTHGGYNCVCVNGWTGEDCSENIDDCASAACFQGATCHDRVASFYCECPHGRTGLLCHLNDACISNPCNEGSNCDTNPVNGKAICTCPSGYTGPACSQDVDECALGANPCEHAGKCLNTLGSFECQCLQGYTGPRCEIDVNECISNPCQNDATCLDQIGEFQCICMPGYEGVYCEINTDECASSPCLHNGHCMDKINEFQCQCPKGFNGHLCQYDVDECASTPCKNGAKCLDGPNTYTCVCTEGYTGTHCEVDIDECDPDPCHYGSCKDGVATFTCLCQPGYTGHHCETNINECHSQPCRHGGTCQDRDNSYLCLCLKGTTGPNCEINLDDCASNPCDSGTCLDKIDGYECACEPGYTGSMCNVNIDECAGSPCHNGGTCEDGIAGFTCRCPEGYHDPTCLSEVNECNSNPCIHGACRDGLNGYKCDCAPGWSGTNCDINNNECESNPCVNGGTCKDMTSGYVCTCREGFSGPNCQTNINECASNPCLNQGTCIDDVAGYKCNCPLPYTGATCEVVLAPCATSPCKNSGVCKESEDYESFSCVCPTGWQGQTCEVDINECVKSPCRHGASCQNTNGSYRCLCQAGYTGRNCESDIDDCRPNPCHNGGSCTDGINTAFCDCLPGFQGAFCEEDINECASNPCQNGANCTDCVDSYTCTCPVGFNGIHCENNTPDCTESSCFNGGTCVDGINSFTCLCPPGFTGSYCQYDVNECDSRPCLHGGTCQDSYGTYKCTCPQGYTGLNCQNLVRWCDSAPCKNGGRCWQTNTQYHCECRSGWTGVNCDVLSVSCEVAAQKRGIDVTLLCQHGGLCVDEGDKHYCHCQAGYTGSYCEDEVDECSPNPCQNGATCTDYLGGFSCKCVAGYHGSNCSEEINECLSQPCQNGGTCIDLTNSYKCSCPRGTQGVHCEINVDDCHPPLDPASRSPKCFNNGTCVDQVGGYTCTCPPGFVGERCEGDVNECLSNPCDPRGTQNCVQRVNDFHCECRAGHTGRRCESVINGCRGKPCKNGGVCAVASNTARGFICRCPAGFEGATCENDARTCGSLRCLNGGTCISGPRSPTCLCLGSFTGPECQFPASSPCVGSNPCYNQGTCEPTSENPFYRCLCPAKFNGLLCHILDYSFTGGAGRDIPPPQIEEACELPECQVDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRELSHVLHTNVVFKRDAQGQQMIFPYYGHEEELRKHPIKRSTVGWATSSLLPGTSGGRQRRELDPMDIRGSIVYLEIDNRQCVQSSSQCFQSATDVAAFLGALASLGSLNIPYKIEAVKSEPVEPPLPSQLHLMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLSDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILLRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGTALGGTPTLSPTLCSPNGYLGNLKSATQGKKARKPSTKGLACGSKEAKDLKARRKKSQDGKGCLLDSSSMLSPVDSLESPHGYLSDVASPPLLPSPFQQSPSMPLSHLPGMPDTHLGISHLNVAAKPEMAALAGGSRLAFEPPPPRLSHLPVASSASTVLSTNGTGAMNFTVGAPASLNGQCEWLPRLQNGMVPSQYNPLRPGVTPGTLSTQAAGLQHSMMGPLHSSLSTNTLSPIIYQGLPNTRLATQPHLVQTQQVQPQNLQLQPQNLQPPSQPHLSVSSAANGHLGRSFLSGEPSQADVQPLGPSSLPVHTILPQESQALPTSLPSSMVPPMTTTQFLTPPSQHSYSSSPVDNTPSHQLQVPEHPFLTPSPESPDQWSSSSPHSNISDWSEGISSPPTTMPSQITHIPEAFK

SEQ ID NO: 3 - protein, 2900 aa, Bos taurus
MTPVCTPTRPGPCAHPALPRSTPHSITDSSRAEPIESFLVLSPALELRLLLAVVGQDTPLGDVWAGGKASGGGDTEGPLSEGSKEGEAATGPQAPGAEWHAPPRSTCLSSTPRPEAVPPSLPCRSPGWGACGGRRPGPALEPAHMGSVPSQQRPPGLDRSREDNGPPQPLPSPHGGASLAPAPPPACRGWQPPLRWPGAAAARVPGHRRTCSPAALCPCCRCLIYWARFSSHCNSRSLPGQDALGPGLWVPSATQAGTRQPVTGSTLSGGHATFPRLQGMALPEPEGEGPPTTSAQGCGPSVRAAFPGRCQLGAVGAFHPRGSAAGKREAWLVPEPLLGFPSSSRLRGDPGGHVPPRLKKPRQQVAKGGPGAGVAGAEPFPVGSAGDQAWGWAGGKAPPTPGSPATVAAREPAQGLPDCGGAFAGQQCQAPNPCLSAPCKNGGTCHTTEREGLVDYVCGCRLGFSGPLCLTPRDHACLASPCLNGGTCDLLTLTEYKCLCTPGWSGKTCQQADPCASNPCANGGQCLPFEASYICHCPPGFHGPTCRQDVNECSQSPGLCHHGGTCLNEVGSYRCVCRPTHTGPHCELPYVPCSPSPCQNGGTCRPTGDTTHECACLPGFTGQNCEENIDDCPGNSCKNGGACVDGVNTYNCRCPPEWTGQYCTEDVDECQLMPNACQNGGTCHNTHGGYNCVCVNGWTGEDCSENIDDCASASCFQGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGLHCEVNTDECASSPCLQNGRCLDKINEFVCECPTGFTGHLCQYDVDECASTPCKNGAKCLDGPNTYTCVCTEGYTGPHCEVDIDECDPDPCHYGSCKDGVATFTCLCQPGYTGHHCESNINECHSQPCRHGGTCQDRDNAYLCFCLKGTTGPNCEINLDDCASNPCDSGTCLDKIDGYECACEPGYTGSMCNINIDECADSPCHNGGTCEDGINGFTCRCPEGYHDPTCLSEVNECSSNPCIHGACRDSLNGYKCDCDPGWSGANCDVNNDECESNPCINGGTCKDMTSGYVCACREGFSGPNCQTNINECASNPCLNQGTCIDDVAGYKCNCLLPYTGATCEVVLAPCAPGPCRNGGECRESEDYESFSCACPAGWQGQTCEIDINECVKSPCRAGASCQNTNGSYRCHCQAGYTGRNCETDIDDCRPNPCHNGGSCTDGINTAFCDCLPGFQGAFCEEDINECASSPCRNGANCTDCVDSYTCTCPTGFSGIHCENNTPDCTESSCFNGGTCVDGINSFTCLCPPGFTGSYCQHDVNECDSRPCLHGGTCHDSYGTYTCTCPQGYTGLNCQTLVRWCDSSPCKNDGRCWQTNALYRCECHSGWTGLYCDVPSVSCEVAARQQGVNVTHLCRNGGLCMNAGNTHRCHCQAGYTGSYCEEQVDECSPSPCQNGATCTDYPGGYSCECVAGYHGVNCSEEVNECLSQPCRNGGTCIDLTNTYKCSCPRGTQGVHCEINVDDCNPPIDPVSRGPKCFNNGTCVDQVGGYSCSCPPGFVGERCEGDVNECLSNPCDARGTQNCVQHVNAFHCECRAGHTGRRCESVINGCKDRPCKNGGSCAVASNTARGFICKCPAGFEGATCENDARSCGSLRCLNGGTCIAGPRSPTCLCLGPFTGPECQFPASSPCVGGNPCYNQGVCEPTAESPFYRCRCPAKFNGLLCHILDYSFGGGVGLDIPPPQIEETCELPGCREEAGNKVCSLQCNSHACGWDGGDCSLDFDDPWQNCTQSLQCWKYFSNGRCDSQCNSAGCLFDGFDCQRAEGQCNPLYDQYCKDHFRDGHCDQGCNSAECEWDGLDCAEHVPERLAAGTLVLVVLMPPEQLRNRSLHFLRELSRLLHTNVVFKRDASGQQMIFPYYGRAPLPAGERSEECRCEHHACPAGAGQGEPSGPLCTSRSIVYLEIDNRQCVQSSSQCFQSATDVAAFLGALASLGSLNIPYKIEAVQSETVEPPPPPPLHFMYVAVVAFVLLFFVGCGVLLSRKRRRQHGQLWFPEGFKVSEASKKKRREPLGEDSVGLKPLKNSSDGALMDDNQNEWGDEGLEAKKFRFEEPVVLPDLDDQTDHRQWTQQHLDAADLRVSAMAPTPPQGEADADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYSLVRSPPLHGATLGGTPTLSPPLCSPNGYLGNLKPPMQGKKARKPSTKGLACGGKEPKDLKARRKKSQDGKGCLLDSGSVMSPVDSLESPHGYLSDVASPPLLPSPFQPSPSVPLNHLPGMPETHLGVSHLSVAAKPEMAVLSGGSRLAFEAGPPRLSHLPVASSTSTILGSGGSGGSGAVNFTVGGAAGLNGQCEWLSRLQNGLVPNQYNPLRGGVTPGTLSTQAAGLQHGTVGPLHAPALSQVMTYQALPSTRLASQPHLVQPQQNLQMQPPSMPPQPNLQPHLGVSSAASGHLGRSFLGGELSQADMQPLGPGNLAAHTVLPQDGQVLPTSLPSTLAPPTMAPPMTTAQFLTPPSQHSYSSSPVDNTPSHQLQVPEHPFLTPSPESPDQWSSSSPHSNISDWSEGISSPPTSVPSQIAHVPEAFK

SEQ ID NO: 4 - protein, 2561 aa, Gallus gallus
MGRCSAAHPRGGVHCPGLCAVPDALLLFPGVRCTQLAESCLNGGKCETFLNGTEVCQCSSAHMGERCQLPNPCLSSPCKNAGTCIPLLRGSTADYTCVCRLGFTDELCLTPLDNACLNNPCRNGGTCDLVTLSEYKCRCPPGWSGKTCQQADPCASNPCANGGQCVPFEAHYICRCTAGFHGANCKQDVNECNISPPVCKNGGSCTNEVGTYQCSCKPAYTGQNCEHLYVPCNPSPCQNGGTCRQTGDTTYDCTCLPGFTGQNCEENIDDCPGNNCRNGGTCVDGVNTYNCQCPPEWTGQYCTEDVDECQLMPNACQNGGTCHNNHGGYNCVCVNGWTGEDCSENIDDCAMAACFQGATCHDRVASFYCECPHGRTGLLCHLDDACISNPCNEGSNCDTNPVNGKAICTCPSGYMGPACNQDVDECSLGANPCEHAGKCINTQGSFQCQCLQGYSGPRCEIDVNECLSNPCQNDATCLDQIGEFQCICMPGYEGVYCEINTDECASSPCLHNGNCLDKINEFHCECPTGFNGHLCQFDIDECASTPCKNGAKCVDGPNTYSCECTEGFSGVHCEIDIDECNPDPCHYGTCKDSIAAFTCLCQPGYTGHRCDININECQSQPCRNGGTCQDRDNAYNCLCLKGTTGPNCEINLDDCASNPCDYGKCIDKINGYECTCEPGYTGRMCNINIDECASNPCHNGGTCKDGINGFTCLCPEGFHDPKCLSEVNECNSNPCIHGRCHDGLNGYRCDCDPGWSGTNCDINNNECESNPCMNGGTCKDMTSGYICTCREGFSGPNCQTNINECASNPCLNQGTCIDDVAGYTCNCLLPYTGATCEDVLAPCAGGPCKNGGECRESEDYKRFSCSCPPGWQGQTCEIDINECVKSPCRNGATCQNTNGSYRCLCRVGFAGRNCDTDIDDCQPNPCHNGGSCSDGIGTFFCECLAGFRGLKCEEDINECASNPCKNGANCTDCVNSYTCTCPSGFSGIHCENNTPDCTESSCFNGGTCVDGINTFTCLCPSGFTGSYCEHNINECDSKPCLNGGTCQDSYGTYKCTCPQGYTGLNCQNLVRWCDSSPCKNGGKCWQTNNLYRCECNSGWTGLYCDVPSVSCEVAAKQQGIDVAHLCRNSGLCVDSGNTHFCRCQAGYTGSYCEEQVDECSPNPCQNGATCTDYLGGYSCECVAGYHGVNCSEEINECLSHPCQNGGTCIDLINTYKCSCPRGTQGVHCEINVDDCSPFFDPVTLGPKCFNNGKCTDRVGGYSCICPPGFVGERCEGDVNECLSNPCDARGTQNCVQRVNDYKCECRPGYAGRRCDTVVDGCKGKPCRNGGTCAVASNTGRGFICKCPPGFVGATCENDSHTCGTLHCLNGGTCISMHKSSKCVCAAAFTGPECQYPASSPCISNPCYNGGTCEFLSDASPYYHCNCPANFNGLNCHILDFDFQGGFGQDIIPPKIEEKCEIAVCASYAGNKICDGKCNNHACGWDGGDCSLNFNDPWKNCSQSLQCWKYFNDGKCDSQCNNAGCLYDGFDCQKYEGQCNPLYDQYCKDHFSDGHCDQGCNNFECEWDGLDCANNMPEKLADGTLVVVVLITPENLKNNSFNFLRELSRVLHTNVVFKKNAKGEYMIFPYYGNEEELKKHYIKRSTEDWADMSSAVINKVKSSLYSRAGRRQKRELDQMDIRGSIVYLEIDNRQCIQSSSQCFQSATDVAAFLGALASLGNLNIPYKIEAVKSETAEPARNSQLYPMYVVVAALVLLAFIGVGVLVSRKRRREHGQLWFPEGFKVTESSKKKRREPLGEDSVGLKPLKNASDGTLMDDNQNEWGDEETLDTKKFRFEEQAMLPDTDDQTDHRQWTQQHLDAADLRISSMAPTPPQGEIDADCMDVNVRGPDGFTPLMIASCSGGGLETGNSEEEDDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINCHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYNLVRSPPLHSGPLGAPTLSPPLCSPSSYIGNLKPAVQGKKARKPSTKGLSCNGKDSKDLKARRKKSQDGKGCLLDNSSVLSPVDSLESPHGYLSDVASPPLMTSPFQQSPSMPLNHLPGMPDAHMSINHLNMAGKQEMALGGSGRMAFEAVPPRLSHLPVSSPSTAMSNAPMNFSVGGAAGLSGQCDWLSRLQSGMVQNQYGAMRGGMQPGTHQQAQNLQHGMMSSLHNGLPSTSLSQMMSYQAMPSTRLASQPHLLQNQQMQQMQQPGMQPQPGMQPQPGMQQPQQQPQQQPQPQQHHNPGSNASGHMGQNFLGTELSQPDMQPVSSSAMAVHTILPQDSQLLPTSLPSSLAQPMTTTQFLTPPSQHSYSSPLDNTPSHQLQVPDHPFLTPSPESPDQWSSSSPHSNVSDWSEGISSPPTSMQSQMGHIPEAFK

SEQ ID NO: 5 - protein, 2531 aa, Rattus rattus
MPRLLAPLLCLTLLPALAARGLRCSQPSGTCLNGGRCEVANGTEACVCSGAFVGQRCQDPSPCLSTPCKNAGTCYVVDHGGIVDYACSCPLGFSGPLCLTPLANACLANPCRNGGTCDLLTLTEYKCRCPPGWSGKSCQQADPCASNPCANGGQCLPFESSYICGCPPGFHGPTCRQDVNECSQNPGLCRHGGTCHNEIGSYRCACRATHTGPHCELPYVPCSPSPCQNGGTCRPTGDTTHECACLPGFAGQNCEENVDDCPGNNCKNGGACVDGVNTYNCRCPPEWTGQYCTEDVDECQLMPNACQNAGTCHNSHGGYNCVCVNGWTGEDCSDNIDDCASAACFQGATCHDRVASFYCECPHGRTGLLCHLNDACISNPCNEGSNCDTNPVNGKAICTCPRGYTGPACSQDVDECALGANPCEHAGKCLNTLGSFECQCLQGYTGPRCEIDVNECISNPCQNDATCLDQIGEFQCICMPGYEGVYCEINTDECASSPCLHNGRCVDKINEFLCQCPKGFSGHLCQYDVDECASTPCKNGAKCLDGPNTYTCVCTEGYTGTHCEVDIDECDPDPCHIGLCKDGVATFTCLCQPGYTGHHCETNINECHSQPCRHGGTCQDRDNYYLCLCLKGTTGPNCEINLDDCASNPCDSGTCLDKIDGYECACEPGYTGSMCNVNIDECAGSPCHNGGTCEDGIAGFTCRCPEGYHDPTCLSEVNECNSNPCIHGACRDGLNGYKCDCAPGWSGTNCDINNNECESNPCVNGGTCKDMTSGYVCTCREGFSGPNCQTNINECASNPCLNQGTCIDDVAGYKCNCPLPYTGATCEVVLAPCATSPCKNSGVCKESEDYESFSCVCPTGWQGQTCEIDINECVKSPCRHGASCQNTNGSYRCLCQAGYTGRNCESDIDDCRPNPCHNGGSCTDGVNAAFCDCLPGFQGAFCEEDINECATNPCQNGANCTDCVDSYTCTCPTGFNGIHCENNTPDCTESSCFNGGTCVDGINSFTCLCPPGFTGSYCQYDVNECDSRPCLHGGTCQDSYGTYKCTCPQGYTGLNCQNLVRWCDSAPCKNGGKCWQTNTQYHCECRSGWTGFNCDVLSVSCEVAAQKRGIDVTLLCQHGGLCVDEEDKHYCHCQAGYTGSYCEDEVDECSPNPCQNGATCTDYLGGFSCKCVAGYHGSNCSEEINECLSQPCQNGGTCIDLTNTYKCSCPRGTQGVHCEINVDDCHPPLDPASRSPKCFNNGTCVDQVGGYTCTCPPGFVGERCEGDVNECLSNPCDPRGTQNCVQRVNDFHCECRAGHTGRRCESVINGCRGKPCRNGGVCAVASNTARGFICRCPARFEGATCENDARTCGSLRCLNGGTCISGPRSPTCLCLGSFTGPECQFPASSPCVGSNPCYNQGTCEPTSESPFYRCLCPAKFNGLLCHILDYSFTGAAGRDIPPPQIEEACELPECQEDAGNKVCNLQCNNHACGWDGGDCSLNFNDPWKNCTQSLQCWKYFSDGHCDSQCNSAGCLFDGFDCQLTEGQCNPLYDQYCKDHFSDGHCDQGCNSAECEWDGLDCAEHVPERLAAGTLVLVVLLPPDQLRNNSFHFLRDVSHVLHTNVVFKRDAQGQQMIFPYYGREEELRKHPIKRSAVGWATTSLLPGTNGGRQRRELDPMDIHGSIVYLEIDNRQCVQSSSQCFQSATDVAAFLGALASLGSLNIPYKIEAVKSETVEPPLPSQLHLMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRVSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILLRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGTALGGTPTLSPTLCSPNGYLGNLKSATQGKKARKPSTKGLACSSKEAKDLKARRKKSQDGKGCLLDSSSMLSPVDSLESPHGYLSDVASPPLLPSPFQQSPSMPLSHLPGMPDTHLGISHLNVAAKPEMAALAGGSRLAFEPPPPRLSHLPVASSASTVLSTNGTGAMNFTVGAPASLNGQCEWLPRLQNGMVPSQYNPLRPGVTPGTLSTQAAGLQHGMMGPIHSSLSTNTLSPIIYQGLPNTRLATQPHLVQTQQVQPQNLQIQPQNLQPPSQPHLSVSSAANGHLGRSFLSGEPSQADVQPLGPSSLPVHTILPQESQALPTSLPSSMVPPMTTTQFLTPPSQHSYSSSPVDNTPSHQLQVPEHPFLTPSPESPDQWSSSSRHSNISDWSEGISSPPTSMPSQITHIPEAFK

SEQ ID NO: 6 - protein, 2471 aa, Homo sapiens
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 7 - protein, 2321 aa, Homo sapiens
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 8 - protein, 2003 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 9 - protein, 2470 aa, mus musculus
MPDLRPAALRALLWLWLCGAGPAHALQCRGGQEPCVNEGTCVTYHNGTGFCRCPEGFLGEYCQHRDPCEKNRCQNGGTCVPQGMLGKATCRCAPGFTGEDCQYSTSHPCFVSRPCQNGGTCHMLSRDTYECTCQVGFTGKQCQWTDACLSHPCENGSTCTSVASQFSCKCPAGLTGQKCEADINECDIPGRCQHGGTCLNLPGSYRCQCGQGFTGQHCDSPYVRGLPCVNGGTCRQTGDFTLECNCLPGFEGSTCERNIDDCPNHKCQNGGVCVDGVNTYNCRCPPQWTGQFCTEDVDECLLQPNACQNGGTCTNRNGGYGCVCVNGWSGDDCSENIDDCAYASCTPGSTCIDRVASFSCLCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEVNECQSNPCVNNGQCVDKVNRFQCLCPPGFTGPVCQIDIDDCSSTPCLNGAKCIDHPNGYECQCATGFTGILCDENIDNCDPDPCHHGQCQDGIDSYTCICNPGYMGAICSDQIDECYSSPCLNDGRCIDLVNGYQCNCQPGTSGLNCEINFDDCASNPCMHGVCVDGINRYSCVCSPGFTGQRCNIDIDECASNPCRKGATCINDVNGFRCICPEGPHHPSCYSQVNECLSNPCIHGNCTGGLSGYKCLCDAGWVGVNCEVDKNECLSNPCQNGGTCNNLVNGYRCTCKKGFKGYNCQVNIDECASNPCLNQGTCFDDVSGYTCHCMLPYTGKNCQTVLAPCSPNPCENAAVCKEAPNFESFSCLCAPGWQGKRCTVDVDECISKPCMNNGVCHNTQGSYVCECPPGFSGMDCEEDINDCLANPCQNGGSCVDHVNTFSCQCHPGFIGDKCQTDMNECLSEPCKNGGTCSDYVNSYTCTCPAGFHGVHCENNIDECTESSCFNGGTCVDGINSFSCLCPVGFTGPFCLHDINECSSNPCLNAGTCVDGLGTYRCICPLGYTGKNCQTLVNLCSRSPCKNKGTCVQEKARPHCLCPPGWDGAYCDVLNVSCKAAALQKGVPVEHLCQHSGICINAGNTHHCQCPLGYTGSYCEEQLDECASNPCQHGATCNDFIGGYRCECVPGYQGVNCEYEVDECQNQPCQNGGTCIDLVNHFKCSCPPGTRGLLCEENIDECAGGPHCLNGGQCVDRIGGYTCRCLPGFAGERCEGDINECLSNPCSSEGSLDCVQLKNNYNCICRSAFTGRHCETFLDVCPQKPCLNGGTCAVASNMPDGFICRCPPGFSGARLQSSCGQVKCRRGEQCIHTDSGPRCFCLNPKDCESGCASNPCQHGGTCYPQRQPPHYSCRCPPSFGGSHCELYTAPTSTPPATCQSQYCADKARDGICDEACNSHACQWDGGDCSLTMEDPWANCTSTLRCWEYINNQCDEQCNTAECLFDNFECQRNSKTCKYDKYCADHFKDNHCDQGCNSEECGWDGLDCASDQPENLAEGTLIIVVLLPPEQLLQDSRSFLRALGTLLHTNLRIKQDSQGALMVYPYFGEKSAAMKKQKMTRRSLPEEQEQEQEVIGSKIFLEIDNRQCVQDSDQCFKNTDAAAALLASHAIQGTLSYPLVSVFSELESPRNAQLLYLLAVAVVIILFFILLGVIMAKRKQAWLPLAAGRFTLRRDSSNHKRREPVGQDAVGLKNLSVQVSEANLIGSGTSEHWVDDEGPQPKKAKAEDEALLSEDDPIDRRPWTQQHLEAADISHTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADRNAQDNMGRCPLHAAVAGDAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVLCGPNRSFLSLKHTPMGKKARRPNTKSTMPTSLPNLAKEAKDAKGSRRKKCLNEKVQLSESSVTLSPVDSLESPHTYVSDATSSPMITSPGILQASPTPLLAAAAPAAPVHTQHALSFSNLHDMQPLAPGASTVLPSVSQLLSHHHIAPPGSSSAGSLGRLHPVPVPADWMNRVEMNETQYSEMFGMVLAPAEGAHPGIAAPQSRPPEGKHMSTQREPLPPIVTFQLIPKRSIAQAAGAPQTQSSCPPAVAGPLPSMYQIPEMPRLPSVAFPPTMMPQQEGQVAQTIVPTYHPFPASVGKYPTPPSQHSYASSNAAERTPSHGGHLQGEHPYLTPSPESPDQWSSSSPHSASDWSDVTTSPTPGGGGGGQRGPGTHMSEPPHSNMQVYA

SEQ ID NO: 10 - protein, 1964 aa, mus musculus
MQPQLLLLLLLPLNFPVILTRELLCGGSPEPCANGGTCLRLSQGQGICQCAPGFLGETCQFPDPCRDTQLCKNGGSCQALLPTPPSSRSPTSPLTPHFSCTCPSGFTGDRCQTHLEELCPPSFCSNGGHCYVQASGRPQCSCEPGWTGEQCQLRDFCSANPCANGGVCLATYPQIQCRCPPGFEGHTCERDINECFLEPGPCPQGTSCHNTLGSYQCLCPVGQEGPQCKLRKGACPPGSCLNGGTCQLVPEGHSTFHLCLCPPGFTGLDCEMNPDDCVRHQCQNGATCLDGLDTYTCLCPKTWKGWDCSEDIDECEARGPPRCRNGGTCQNTAGSFHCVCVSGWGGAGCEENLDDCAAATCAPGSTCIDRVGSFSCLCPPGRTGLLCHLEDMCLSQPCHVNAQCSTNPLTGSTLCICQPGYSGSTCHQDLDECQMAQQGPSPCEHGGSCINTPGSFNCLCLPGYTGSRCEADHNECLSQPCHPGSTCLDLLATFHCLCPPGLEGRLCEVEVNECTSNPCLNQAACHDLLNGFQCLCLPGFTGARCEKDMDECSSTPCANGGRCRDQPGAFYCECLPGFEGPHCEKEVDECLSDPCPVGASCLDLPGAFFCLCRPGFTGQLCEVPLCTPNMCQPGQQCQGQEHRAPCLCPDGSPGCVPAEDNCPCHHGHCQRSLCVCDEGWTGPECETELGGCISTPCAHGGTCHPQPSGYNCTCPAGYMGLTCSEEVTACHSGPCLNGGSCSIRPEGYSCTCLPSHTGRHCQTAVDHCVSASCLNGGTCVNKPGTFFCLCATGFQGLHCEEKTNPSCADSPCRNKATCQDTPRGARCLCSPGYTGSSCQTLIDLCARKPCPHTARCLQSGPSFQCLCLQGWTGALCDFPLSCQMAAMSQGIEISGLCQNGGLCIDTGSSYFCRCPPGFQGKLCQDNMNPCEPNPCHHGSTCVPQPSGYVCQCAPGYEGQNCSKVLEACQSQPCHNHGTCTSRPGGFHCACPPGFVGLRCEGDVDECLDRPCHPSGTAACHSLANAFYCQCLPGHTGQRCEVEMDLCQSQPCSNGGSCEITTGPPPGFTCHCPKGFEGPTCSHKALSCGIHHCHNGGLCLPSPKPGSPPLCACLSGFGGPDCLTPPAPPGCGPPSPCLHNGTCTETPGLGNPGFQCTCPPDSPGPRCQRPGASGCEGRGGDGTCDAGCSGPGGDWDGGDCSLGVPDPWKGCPPHSQCWLLFRDGRCHPQCDSEECLFDGYDCEIPLTCIPAYDQYCRDHFHNGHCEKGCNNAECGWDGGDCRPEGEDSEGRPSLALLVVLRPPALDQQLLALARVLSLTLRVGLWVRKDSEGRNMVFPYPGTRAKEELSGARDSSSWERQAPPTQPLGKETESLGAGFVVVMGVDLSRCGPEHPASRCPWDSGLLLRFLAAMAAVGALEPLLPGPLLAAHPQAGTRPPANQLPWPILCSPVVGVLLLALGALLVLQLIRRRRREHGALWLPPGFIRRPQAQQAPHRRRPPLGEDNIGLKALKPEAEVDEDGVAMCSGPEEGEAEETASASRCQLWPLNSSCGELPQAAMLTPPQECESEVLDVDTCGPDGVTPLMSAVFCGGVQSTTGASPQRLGLGNLEPWEPLLDRGACPQAHTVGTGETPLHLAARFSRPTAARRLLEAGANPNQPDRAGRTPLHTAVAADAREVCQLLLASRQTSVDARTEDGTTPLMLAARLAVEDLVEELIAARADVGARDKRGKTALHWAAAVNNARAARSLLQAGADKDAQDSREQTPLFLAAREGAVEVAQLLLELGAARGLRDQAGLAPGDVARQRSHWDLLTLLEGAGPTTQEARAHARTTPGGGAAARCRTLSAGARPRGGGACLQARTWSVDLGARGGKVYARCRSRSGSCGGPTTRGRRFSAGSRGRRGARASQDDWPRDWVALEACGSACSAPIPPPSLTPSPERGSPQVAWGLPVHQEIPLNSVVRNLN

SEQ ID NO: 11 - protein, 2318 aa, mus musculus
MGLGARGRRRRRRLMALPPPPPPMRALPLLLLLAGLGAAAPPCLDGSPCANGGRCTHQQPSLEAACLCLPGWVGERCQLEDPCHSGPCAGRGVCQSSVVAGTARFSCRCLRGFQGPDCSQPDPCVSRPCVHGAPCSVGPDGRFACACPPGYQGQSCQSDIDECRSGTTCRHGGTCLNTPGSFRCQCPLGYTGLLCENPVVPCAPSPCRNGGTCRQSSDVTYDCACLPGFEGQNCEVNVDDCPGHRCLNGGTCVDGVNTYNCQCPPEWTGQFCTEDVDECQLQPNACHNGGTCFNLLGGHSCVCVNGWTGESCSQNIDDCATAVCFHGATCHDRVASFYCACPMGKTGLLCHLDDACVSNPCHEDAICDTNPVSGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSMCQLDVDECASTPCRNGAKCVDQPDGYECRCAEGFEGTLCERNVDDCSPDPCHHGRCVDGIASFSCACAPGYTGIRCESQVDECRSQPCRYGGKCLDLVDKYLCRCPPGTTGVNCEVNIDDCASNPCTFGVCRDGINRYDCVCQPGFTGPLCNVEINECASSPCGEGGSCVDGENGFHCLCPPGSLPPLCLPANHPCAHKPCSHGVCHDAPGGFRCVCEPGWSGPRCSQSLAPDACESQPCQAGGTCTSDGIGFRCTCAPGFQGHQCEVLSPCTPSLCEHGGHCESDPDRLTVCSCPPGWQGPRCQQDVDECAGASPCGPHGTCTNLPGNFRCICHRGYTGPFCDQDIDDCDPNPCLHGGSCQDGVGSFSCSCLDGFAGPRCARDVDECLSSPCGPGTCTDHVASFTCACPPGYGGFHCEIDLPDCSPSSCFNGGTCVDGVSSFSCLCRPGYTGTHCQYEADPCFSRPCLHGGICNPTHPGFECTCREGFTGSQCQNPVDWCSQAPCQNGGRCVQTGAYCICPPGWSGRLCDIQSLPCTEAAAQMGVRLEQLCQEGGKCIDKGRSHYCVCPEGRTGSHCEHEVDPCTAQPCQHGGTCRGYMGGYVCECPAGYAGDSCEDNIDECASQPCQNGGSCIDLVARYLCSCPPGTLGVLCEINEDDCDLGPSLDSGVQCLHNGTCVDLVGGFRCNCPPGYTGLHCEADINECRPGACHAAHTRDCLQDPGGHFRCVCHPGFTGPRCQIALSPCESQPCQHGGQCRHSLGRGGGLTFTCHCVPPFWGLRCERVARSCRELQCPVGIPCQQTARGPRCACPPGLSGPSCRVSRASPSGATNASCASAPCLHGGSCLPVQSVPFFRCVCAPGWGGPRCETPSAAPEVPEEPRCPRAACQAKRGDQNCDRECNTPGCGWDGGDCSLNVDDPWRQCEALQCWRLFNNSRCDPACSSPACLYDNFDCYSGGRDRTCNPVYEKYCADHFADGRCDQGCNTEECGWDGLDCASEVPALLARGVLVLTVLLPPEELLRSSADFLQRLSAILRTSLRFRLDARGQAMVFPYHRPSPGSESRVRRELGPEVIGSVVMLEIDNRLCLQSAENDHCFPDAQSAADYLGALSAVERLDFPYPLRDVRGEPLEAPEQSVPLLPLLVAGAVFLLIIFILGVMVARRKREHSTLWFPEGFALHKDIAAGHKGRREPVGQDALGMKNMAKGESLMGEVVTDLNDSECPEAKRLKVEEPGMGAEEPEDCRQWTQHHLVAADIRVAPATALTPPQGDADADGVDVNVRGPDGFTPLMLASFCGGALEPMPAEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHLANREITDHLDRLPRDVAQERLHQDIVRLLDQPSGPRSPSGPHGLGPLLCPPGAFLPGLKAVQSGTKKSRRPPGKTGLGPQGTRGRGKKLTLACPGPLADSSVTLSPVDSLDSPRPFSGPPASPGGFPLEGPYATTATAVSLAQLGASRAGPLGRQPPGGCVLSFGLLNPVAVPLDWARLPPPAPPGPSFLLPLAPGPQLLNPGAPVSPQERPPPYLAAPGHGEEYPAAGTRSSPTKARFLRVPSEHPYLTPSPESPEHWASPSPPSLSDWSDSTPSPATATNATASGALPAQPHPISVPSLPQSQTQLGPQPEVTPKRQVMA

SEQ ID NO: 12 - protein, 2471 aa, Rattus norvegicus
MPALRPAALRALLWLWLCGAGPAHALQCRGGQEPCVNEGTCVTYHNGTGYCRCPEGFLGEYCQHRDPCEKNRCQNGGTCVTQAMLGKATCRCAPGFTGEDCQYSTSHPCFVSRPCQNGGTCHMLSWDTYECTCQVGFTGKQCQWTDVCLSHPCENGSTCSSVANQFSCRCPAGITGQKCDADINECDIPGRCQHGGTCLNLPGSYRCQCPQRFTGQHCDSPYVPCAPSPCVNGGTCRQTGDFTSECHCLPGFEGSNCERNIDDCPNHKCQNGGVCVDGVNTYNCRCPPQWTGQFCTEDVDECLLQPNACQNGGTCTNRNGGYGCVCVNGWSGDDCSENIDDCAFASCTPGSTCIDRVASFSCLCPEGKAGLLCHLDDACISNPCHKGALCDTNPLNGQYICTCPQAYKGADCTEDVDECAMANSNPCEHAGKCVNTDGAFHCECLKGYAGPRCEMDINECHSDPCQNDATCLDKIGGFTCLCMPGFKGVHCELEVNECQSNPCVNNGQCVDKVNRFQCLCPPGFTGPVCQIDIDDCSSTPCLNGAKCIDHPNGYECQCATGFTGTLCDENIDNCDPDPCHHGQCQDGIDSYTCICNPGYMGAICSDQIDECYSSPCLNDGRCIDLVNGYQCNCQPGTSGLNCEINFDDCASNPCLHGACVDGINRYSCVCSPGFTGQRCNIDIDECASNPCRKDATCINDVNGFRCMCPEGPHHPSCYSQVNECLSSPCIHGNCTGGLSGYKCLCDAGWVGINCEVDKNECLSNPCQNGGTCNNLVNGYRCTCKKGFKGYNCQVNIDECASNPCLNQGTCLDDVSGYTCHCMLPYTGKNCQTVLAPCSPNPCENAAVCKEAPNFESFTCLCAPGWQGQRCTVDVDECVSKPCMNNGICHNTQGSYMCECPPGFSGMDCEEDINDCLANPCQNGGSCVDKVNTFSCLCLPGFVGDKCQTDMNECLSEPCKNGGTCSDYVNSYTCTCPAGFHGVHCENNIDECTESSCFNGGTCVDGINSFSCLCPVGFTGPFCLHDINECSSNPCLNSGTCVDGLGTYRCTCPLGYTGKNCQTLVNLCSPSPCKNKGTCAQEKARPRCLCPPGWDGAYCDVLNVSCKAAALQKGVPVEHLCQHSGICINAGNTHHCQCPLGYTGSYCEEQLDECASNPCQHGATCSDFIGGYRCECVPGYQGVNCEYEVDECQNQPCQNGGTCIDLVNHFKCSCPPGTRGLLCEENIDDCAGAPHCLNGGQCVDRIGGYSCRCLPGFAGERCEGDINECLSNPCSSEGSLDCIQLKNNYQCVCRSAFTGRHCETFLDVCPQKPCLNGGTCAVASNVPDGFICRCPPGFSGARCQSSCGQVKCRRGEQCVHTASGPHCFCPNHKDCESGCASNPCQHGGTCYPQRQPPYYSCRCSPPFWGSHCESYTAPTSTPPATCLSQYCADKARDGICDEACNSHACQWDGGDCSLTMEDPWANCTSSLRCWEYINNQCDELCNTAECLFDNFECQRNSKTCKYDKYCADHFKDNHCDKGCNNEECGWDGLDCAADQPENLAEGILVIVVLLPPEQLLQDSRSFLRALGTLLHTNLRIKQDSQGALMVYPYYGEKSAAMKKQKVARRSLPDEQEQEIIGSKVFLEIDNRQCVQDSDQCFKNTDAAAALLASHAIQGTLSYPLVSVVSESEDPRNTPLLYLLAVAVVIILFLILLGVIMAKRKRKHGFLWLPEGFTLRRDSSNHKRREPVGQDAVGLKNLSVQVSEANLIGSTTSEHWGDDEGPQPKKAKAEDDEALLSEDDPVDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVLCGPNRSFLSLKHTPMGKKARRPNTKSTMPTSLPNLAKEAKDVKGSRRKKCLNEKVQLSESSVTLSPVDSLESPHTYVSDATSSPMITSPGILQASPTPLLAAAPAAPVHAQHALSFSNLHEMQPLRPGASTVLPSVSQLLSHHHIVPPGSGSAGSLGRLHSVPVPSDWMNRVEMSETQYSEMFGMVLAPAEGTHPGMAAPQSRAPEGKPIPTQREPLPPIVTFQLIPKGSLAQAAGAPQTQSGCPPAVAGPLPSMYQIPEMARLPSVAFPPTMMPQQEGQVAQTIVPTYHPFPASVGKYPTPPSQHSYASSNAAERTPNHGGHLQGEHPYLTPSPESPDQWSSSSPHSASDWSDVTTSPTPGGGGGGQRGPGTHMSEPPHSNMQVYA

SEQ ID NO: 13 - protein, 2319 aa, Rattus norvegicus
MGPGARGRRRRRRLMALPPPPPPMRALPLLLLLLAGLGAAAPPCLDGSPCANGGRCTHQQPSREAACLCLPGWVGERCQLEDPCHSGPCAGRGVCQSSVVAGVARFSCRCLRGFRGPDCSLPDPCFSSPCAHGAPCSVGSDGRYACACPPGYQGRNCRSDIDECRAGASCRHGGTCINTPGSFHCLCPLGYTGLLCENPIVPCAPSPCRNGGTCRQSSDVTYDCACLPGFEGQNCEVNVDDCPGHRCLNGGTCVDGVNTYNCQCPPEWTGQFCTEDVDECQLQPNACHNGGTCFNLLGGHSCVCVNGWTGESCSQNIDDCATAVCFHGATCHDRVASFYCACPMGKTGLLCHLDDACVSNPCHEDAICDTNPVSGRAICTCPPGFTGGACDQDVDECSIGANPCEHLGRCVNTQGSFLCQCGRGYTGPRCETDVNECLSGPCRNQATCLDRIGQFTCICMAGFTGTFCEVDIDECQSSPCVNGGVCKDRVNGFSCTCPSGFSGSTCQLDVDECASTPCRNGAKCVDQPDGYECRCAEGFEGTLCERNVDDCSPDPCHHGRCVDGIASFSCACAPGYTGIRCESQVDECRSQPCRYGGKCLDLVDKYLCRCPPGTTGVNCEVNIDDCASNPCTFGVCRDGINRYDCVCQPGFTGPLCNVEINECASSPCGEGGSCVDGENGFHCLCPPGSLPPLCLPANHPCAHKPCSHGVCHDAPGGFQCVCDPGWSGPRCSQSLAPDACESQPCQAGGTCTSDGIGFHCTCAPGFQGHQCEVLSPCTPSLCEHGGHCESDPDQLTVCSCPPGWQGPRCQQDVDECAGASPCGPHGTCTNLPGSFRCICHGGYTGPFCDQDIDDCDPNPCLNGGSCQDGVGSFSCSCLSGFAGPRCARDVDECLSSPCGPGTCTDHVASFTCTCPPGYGGFHCETDLLDCSPSSCFNGGTCVDGVNSFSCLCRPGYTGTHCQYKVDPCFSRPCLHGGICNPTHSGFECTCREGFTGNQCQNPVDWCSQAPCQNGGRCVQTGAYCICPPEWSGPLCDIPSLPCTEAAAHMGVRLEQLCQAGGQCIDKDHSHYCVCPEGRMGSHCEQEVDPCTAQPCQHGGTCRGYMGGYVCECPTGYSGDSCEDDVDECASQPCQNGGSCIDLVAHYLCSCPPGTLGVLCEINEDDCGPGPSLDSGLRCLHNGTCVDLVGGFRCNCPPGYTGLHCEADINECRPGTCHAAHTRDCLQDPGGHFRCICLPGFTGPRCQTALFPCESQPCQHGGQCRPSLGRGGGLTFTCHCVQPFWGLRCERVARSCRELQCPVGIPCQQTARGPRCACPPGLSGPSCRVSRASPSGATNTSCAATPCLHGGSCLPVQSVPFFRCVCAPGWGGPRCETPSAAPEVPEEPRCPRAACQAKRGDQNCDRECNSPGCGWDGGDCSLNVDDPWRQCEALQCWRLFNNSRCDPACSSPACLYDNFDCYSGGRDRTCNPVYKKYCADHFADGRCDQGCNTEECGWDGLDCASEVPALLARGVLVLTVLLPPEELLRSSADFLQRLSAILRTSLRFRLDARGQAMVFPYHRPSPGSESRVRRELGPEVIGSVVMLEIDNRLCLKSAENDHCFPDAQSAADYLGALSAVERLDFPYPLRDVRGEPLEPPEQSVPLLPLLVAGAVFLLVIFVLGVMVARRKREHSTLWFPEGFALHKDIAAGHKGRREPVGQDALGMKNMTKGESLMGEVATDWNDSECPEAKRLKVEEPGMGAEEPVDCRQWTQHHLVAADIRVAPAMALTPPQGDADADGMDVNVRGPDGFTPLMLASFCGGALEPMPAEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPSGPHGLGPLLCPPGAFLPGLKAVQSGTKKSRRPPGKTGLGPQGTRGRGKKLTLACPGPLADSSVTLSPVDSLDSPRPFGGPPASPGGFPLEGPYATTATTVSLAQLGASRAGPLGRQPPGGCVLSLGLLNPVAVPLDWARLPPPAPPGPSFLLPLAPGSQLLNPATPVSPHERPPPYLAAPGHGEEYPAAGTHSSPTKARFLRVPSEHPYLTPSPESPEHWASPSPPSLSDWSDSTPSPATATSATAAGALPAQPHPISVPSLPQSQTQLGPQPEVTPKRQVMA

SEQ ID NO: 14 - protein, 2471 aa, Bos taurus
MPALRPAPLWALLALWLCRAAPARALQCRDGYEPCVNEGICVTYHNGTGYCKCPEGFLGEYCQHRDPCEKNRCQNGGTCVAQAMLGKATCRCAPGFTGEDCQHSTTHPCFVSHPCLNGGTCHVLSRDTYECTCQVGFTGKLCQWTDACLSHPCANGSTCTTMANQFSCTCLAGFTGQKCETDVNECDIPGQCQHGGTCLNLPGSYQCQCPQGFTGQHCDSPYVPCAPSPCVNGGTCRQTGDFTFECSCLPGFEGVTCERNIDDCPNHKCQNGGVCVDGVNTYNCRCPPQWTGQFCTEDVDECLLQPNACQNGGTCTNRNGGYGCVCVNGWSGDDCSENIDDCAFASCTPGSTCIDRVASFSCMCPEGKAGLLCHLDDACISNPCHKGALCDTNPLNGQYICTCPQGYKGSDCTEDVDECAMANSNPCEHAGKCVNTDGAFHCECLKGYAGPRCEMDINECHSDPCKNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNEGRCIDLVNGYQCNCQPGTSGVNCEINFDDCASNPCVHGVCMDGVNRYSCVCSPGFTGQRCNIDIDECASNPCRKGATCINDVNGFRCICPEGPHHPSCYSQVNECLSNPCVHGNCTGGLTGYKCLCDAGWVGINCEVDKNECLSNPCQNGGTCDNLVNGYRCTCKKGFKGYNCQVNIDECASNPCLNQGTCLDDVSGYTCHCVLPYTGKNCQTVLAPCSPNPCENAGVCKEAPNFESYSCLCAPGWQGQRCTIDIDECVSKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCPAGFDGVHCENNIDECTESSCFNGGTCIDGINSFSCLCPVGFTGSFCLHEINECNSHPCLNEGVCVDGLGTYRCICPLGYTGKNCQTLVNLCSRSPCKNKGTCIQDKAESRCLCPSGWAGAYCDVPSVSCEVAASHRGVPVDRLCQHSGVCISAGNSHHCQCPLGYTGSYCEDQLDECSSNPCQHGATCRDFIGGYRCECVPGYQGVNCEYEVDECQNQPCQNGGTCIDLVNHFKCSCPPGTRGLLCEENVDDCARGPHCLNGGQCVDRIGGYSCRCLPGFAGERCEGDINECLSNPCSSEGSLDCIQLTNDYLCVCRSTFTGRHCETFVDVCPQMPCLNGGTCAVASNMPDGFICRCPPGFSGARCQSSCGQVKCRRGEQCVHTASGPRCFCPNPQDCDSGCASSPCQHGGSCYPQRQPPYYSCQCAPPFRGSHCELYTAPTSTPPATCLSQYCADKARDGICDDVCNSHACQWDGGDCSLTMEDPWANCSSPLPCWEYINNQCDELCNTAECLFDNFECQKSSKTCKYDKYCADHYEDNHCDQGCNSEECGWDGLDCAADRPENLAEGTLVIVVLMPPEQLLQDARRFLRALGTLLHTNLRIKRSAQGELMVYPYYGGKSAAMKKQRLTRRSLPGDEEQEVAGSQVFLEIDNRQCVQDSDQCFKNTDAAAALLASHAIQGTLSYPLVSVVSESLTPKPTQLLYLLAVAVVIILFIILLGVIMAKRKRKHGSLWLPEGFTLRRDSSNHKRREPVGQDAVGLKNLSVQVSEANLIGSGTSEHWVDDEGPQPKKAKAEDEALLSEEDDPIDRRPWTQQHLEAADIRRTPSLALTPPQAEQEVDVLDVNVRGPDGCTPLMLASLRGGSSDMSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRPFLSLKHTPMGKKSRRPNTKSTVPTSLPNLAKEAKDAKGNRRKKSLSDKGQLSESSVTLSPVDSLESPHTYVSDTTSSPMITSPGILQASPNPMLATAAPTAPVHAQHALSFSNLHEMQPLAHGANTVLPSVSQLLSHRHIVPPGSSTAGSLGRLHSVTVPADWMNRVEMNESQYNEMFGMVLAPAEGTHPGIAPQSRPPEGKHLTTPREPLPPIVTFQLIPKGSIAQPTGAAQPPSNCPPAVAGTLPTMYQIPEMARLPSMAFPTAMMPQQDGQVAQTILPAYHAFPASVGKYPTPPSQHSYASSNAAERTPSHSGHLQGEHPYLTPSPESPDQWSSSSPHSASDWSDVTTSPTPGGAGGGQRGPGTHMSEPPRSNMQVYA

SEQ ID NO: 15 - protein, 2332 aa, Bos taurus
MGPGPRGRRPRRRRPMSPPPPLPSVRTLPLLLLLVGPGAAAPPCLDGSPCVNGGRCTQLPSREAACLCPPGWVGERCQLEDPCHSGPCAGRGVCQSSVVAGTARFTCRCPRGFRGPDCSLPDPCLSSPCAHGARCSVGSDGRYLCSCPPGYQGRSCRSDVDECRMGGPCRHGGTCLNTPGSFRCQCPGGYTGPLCESPAVPCAPSPCRNGGTCRQSGDLTYDCACLPGFEGQNCEVNVDDCPGHRCLNGGTCVDGVNTYNCQCSPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDMDECQSSPCVNGGVCKDRVNGFSCTCPSGFSGAMCQLDVDECASTPCRNGAKCVDQPDGYECRCAEGFEGTVCERNVDDCSPDPCHHGRCVDGIASFSCACAPGYTGMRCESQVDECRSQPCRHGGKCLDLVDKYLCRCPPGTTGVNCEVNTDDCASNPCTFGVCRDGINRYDCVCQPGFTGPLCNVEINECASNPCGEGASCVDGENGFRCLCPPGSLPPLCLPPSHPCAQEPCSHGVCHDAPGGFRCVCEPGWSGPQCSQSLTRDACESHPCRAGGTCTSDGMGFRCTCPPGVQGHQCELLSPCTPNPCEHGGYCESAPGQMAVCSCTPGWQGPRCQQDVDECASPSPCGPHGTCTNLAGSFSCTCHEGYSGPSCDQDIDDCDPNPCLNGGSCQDGVGSFSCSCLPGFAGPRCARDVDECLSSPCGSGTCTDHVASFTCTCPPGYSGFHCEQDLPDCSPSSCFNGGTCVDGVNSFTCLCRPGYTGTHCQHEADPCLSRPCMHGGVCTAAHPGFHCACPDGFTGAQCQTLVDWCSRSPCQNGGRCARTGASFYCLCPPGWSGRLCDIRSLPCREAAAQIGVPTEQLCQAGGQCVDKDSSHYCVCPEGHTGSHCEQEMDPCLAQPCQHGGTCRGYTGGYVCECPAGYTGDNCEDDVDECASQPCQHGGICIDLVAHYLCSCPPGTLGVLCEINEDDCGPGPALDLGPRCLHNGTCVDLVGGFRCTCPPGYTGLRCEGDINECRPGACHVAHTRDCLQDPGGGFRCLCHPGFTGPRCQTVLSPCESQPCQHGGQCRPSPGPGGVLTFSCHCIPPFWGPRCERVARSCRELQCPVGVPCQQTVRGPRCACPPGLSGPACRGSRGLTPGAANASCVTSPCLHGGSCRPEPLAPFFRCACASGWAGPRCEVPATMPEVSVAMPEVPEEPACPRAACEAKSGDKNCDRECNSPGCGWDGGDCSLSVSDPWRQCAALQCWLLFNNSRCDPACSSPACLYDNFDCRAGGRERTCNPVYEKYCADHFADGRCDQGCNTEECGWDGLDCAGEVPALLARGVLVLTVLLPPEELLRSSADFLQRLSGILRTSLRFRLDENGQAMVFPYHRPGPGAESRNRRELAPEVIGSVVMLEIDNRLCLQSPENDHCFPDAQSAADYLGALSAVERLDFPYPLRAARGEPVELPEPSVPLLPLLAASGIFLLVLLVLGVMVARRKREHSTLWFPEGFALHKDVAVGHKGRREPVGQDALGMKNMAKGESLMGEVATDWMDTECPEAKRLKVEEPGVGTEDAVDCRQWTQHHLVAADIRVAPAMALTPPQGDADADGMDVNVRGPDGFTPLMLASFCGGALEPIPTEEDEAEDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSFEAAKLLLDHFANREITDHLDRLPRDVAQERLHQDIVRLLDQPSGPRSPAGPHGLGPLLCPPGAFLPGLKVAQSGAKKSRRPPGKAGLGPQGTRGRGKKLTLACPGPLADSSVTLSPVDSLDSPRPFGGPPASPGGFPLEGPYAAATATAVSLAQLGGAGRAGLGRQPPGGCVLSLGLLNPVAVPLDWARLPPPAPPGPSFLLPLAPGPQLLNPGNPVSPQERPPPYLAAPGHGEEFPAVAAAHGSPPKARFLRVPSEHPYLTPSPESPEHWASPSPPSLSDWSDSTPSPATATGASATAAGSLSAQPLPLSVPGALAQAQTQLGPQPEVTTKRQVLA

SEQ ID NO: 16 - protein, 2534 aa, Bos taurus
MPPLLAPLLCLALLPALAARGLRCSQPGETCLNGGKCEVFPNGTEACICGGAFAGQQCQAPNPCLSAPCKNGGTCHTTEREGLVDYVCGCRLGFSGPLCLTPRDHACLASPCLNGGTCDLLTLTEYKCLCTPGWSGKTCQQADPCASNPCANGGQCLPFEASYICHCPPGFHGPTCRQDVNECSQSPGLCHHGGTCLNEVGSYRCVCRPTHTGPHCELPYVPCSPSPCQNGGTCRPTGDTTHECACLPGFTGQNCEENIDDCPGNSCKNGGACVDGVNTYNCRCPPEWTGQYCTEDVDECQLMPNACQNGGTCHNTHGGYNCVCVNGWTGEDCSENIDDCASASCFQGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGLHCEVNTDECASSPCLQNGRCLDKINEFVCECPTGFTGHLCQYDVDECASTPCKNGAKCLDGPNTYTCVCTEGYTGPHCEVDIDECDPDPCHYGSCKDGVATFTCLCQPGYTGHHCESNINECHSQPCRHGGTCQDRDNAYLCFCLKGTTGPNCEINLDDCASNPCDSGTCLDKIDGYECACEPGYTGSMCNINIDECADSPCHNGGTCEDGINGFTCRCPEGYHDPTCLSEVNECSSNPCIHGACRDSLNGYKCDCDPGWSGANCDVNNDECESNPCINGGTCKDMTSGYVCACREGFSGPNCQTNINECASNPCLNQGTCIDDVAGYKCNCLLPYTGATCEVVLAPCAPGPCRNGGECRESEDYESFSCACPAGWQGQTCEIDINECVKSPCRAGASCQNTNGSYRCHCQAGYTGRNCETDIDDCRPNPCHNGGSCTDGINTAFCDCLPGFQGAFCEEDINECASSPCRNGANCTDCVDSYTCTCPTGFSGIHCENNTPDCTESSCFNGGTCVDGINSFTCLCPPGFTGSYCQHDVNECDSRPCLHGGTCHDSYGTYTCTCPQGYTGLNCQTLVRWCDSSPCKNDGRCWQTNALYRCECHSGWTGLYCDVPSVSCEVAARQQGVNVTHLCRNGGLCMNAGNTHRCHCQAGYTGSYCEEQVDECSPSPCQNGATCTDYPGGYSCECVAGYHGVNCSEEVNECLSQPCRNGGTCIDLTNTYKCSCPRGTQGVHCEINVDDCNPPIDPVSRGPKCFNNGTCVDQVGGYSCSCPPGFVGERCEGDVNECLSNPCDARGTQNCVQHVNAFHCECRAGHTGRRCESVINGCKDRPCKNGGSCAVASNTARGFICKCPAGFEGATCENDARSCGSLRCLNGGTCIAGPRSPTCLCLGPFTGPECQFPASSPCVGGNPCYNQGVCEPTAESPFYRCRCPAKFNGLLCHILDYSFGGGVGLDIPPPQIEETCELPGCREEAGNKVCSLQCNSHACGWDGGDCSLDFDDPWQNCTQSLQCWKYFSNGRCDSQCNSAGCLFDGFDCQRAEGQCNPLYDQYCKDHFRDGHCDQGCNSAECEWDGLDCAEHVPERLAAGTLVLVVLMPPEQLRNRSLHFLRELSRLLHTNVVFKRDASGQQMIFPYYGQEPHCRQGSAPRSVGVSTTHALLVLDKASPQGHCAPPGLFLSIVYLEIDNRQCVQSSSQCFQSATDVAAFLGALASLGSLNIPYKIEAVQSETVEPPPPPPLHFMYVAVVAFVLLFFVGCGVLLSRKRRRQHGQLWFPEGFKVSEASKKKRREPLGEDSVGLKPLKNSSDGALMDDNQNEWGDEGLEAKKFRFEEPVVLPDLDDQTDHRQWTQQHLDAADLRVSAMAPTPPQGEADADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYSLVRSPPLHGATLGGTPTLSPPLCSPNGYLGNLKPPMQGKKARKPSTKGLACGGKEPKDLKARRKKSQDGKGCLLDSGSVMSPVDSLESPHGYLSDVASPPLLPSPFQPSPSVPLNHLPGMPETHLGVSHLSVAAKPEMAVLSGGSRLAFEAGPPRLSHLPVASSTSTILGSGGSGGSGAVNFTVGGAAGLNGQCEWLSRLQNGLVPNQYNPLRGGVTPGTLSTQAAGLQHGTVGPLHAPALSQVMTYQALPSTRLASQPHLVQPQQNLQMQPPSMPPQPNLQPHLGVSSAASGHLGRSFLGGELSQADMQPLGPGNLAAHTVLPQDGQVLPTSLPSTLAPPTMAPPMTTAQFLTPPSQHSYSSSPVDNTPSHQLQVPEHPFLTPSPESPDQWSSSSPHSNISDWSEGISSPPTSVPSQIAHVPEAFK

SEQ ID NO: 17 - protein, 2107 aa, Pongo abelii
MPPLLAPLLCLALLPALAARGPRCSQPGETCLNGGKCEAANGTEACVCGGAFVGPRCQDPNPCLSTPCKNAGTCHVVDRGGVADYACSCPLGFSGPLCLTPLDNACLTNPCRNGGTCDLLTLMEYKCRCPPGWSGKSCQQADPCASNPCTNGGQCLPFEASYICHCPPSFHGPTCRQDVNECGQNPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECNPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCINGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQAGQTCEVDINECVLSPCRHGASCQNTHGGYRCHCQAGYSGRNCETDIDDCRPNPCHNGGSCTDGINTAFCDCLPGFQGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKWQTHTQYRCECPSGWTGLYCDVPSVSCEVAAQRQGVDVAHLCQHGGLCVDAGNTHHCRCQAGYTGSYCEDLVDECSPSPCQNGGTCTDYLGGYSCKCVAGYHGVNCSEEIDECLSHPCQNGGTCLDLPNTYKCSCPRGTQGVHCEINVDDCNPPVDPMSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPASIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLVISDVIYQGASMHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGAPLGGTPTLSPPLCSPNGYLGSLKPSVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSGSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPPNIQQQQSLQPPPPPPQPHLGVSSAASGHLSRSFLGGEPSQADVQPLGPSSLAVHTILPQESPALPTSLPSSLVPPVTAAQFLTPPSQHSYSSSPVDNTPSHQLQVPEHPFLTPSPESPDQWSSSSPHSNVSDWSEGVSSPPTSMQSQIARIPEAFK

SEQ ID NO: 18 - protein, 2556 aa, Macaca mulatta
MPPLLAPLLCLALLPALAARGPRCSQPGETCLNGGKCEAANGTEACVCGGAFVGPRCQDPNPCLSTPCKNAGTCHVVDRGGMADYACSCPLGFSGPLCLTPLDNACLTNPCRNGGTCDLLTLTEYKCRCPPGWSGKSCQQADPCASNPCANGGQCLPFEASYICHCPPSFHGPTCRQDVNECGQNPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGMHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCQDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRESEDYESFSCVCPTGWQGQTCEVDINECVVSPCRHGASCQNTHGGYRCHCQAGYSGRNCETDIDDCRPNPCHNGGSCTDGINTAFCDCLPGFQGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVAQLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPQIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPEALLGQVKASLLPGGGGGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGSRLAFEAGPPRLSHLPVASGTSTVLGCSSGGAMNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPPNIQQQPNLQPPPPPPQPHLGVSSAASGHLGRSFLGGEPSQADVQPLGPSSLAVHTILPQESPALPTSLPSSLVPPVTAAQFLTPPSQHSYSSSPVDNTPSHQLQVPEHPFLTPSPESPDQWSSSSPHSNVSDWSEGVSSPPTSMQSQIARIPEAFK

SEQ ID NO: 19 - protein, 2555 aa, Pan troglodytes
MPPLLAPLLCLALLPALAARGPRCSQPGETCLNGGKCEAANGTEACVCGGAFVGPRCQDPNPCLSTPCKNAGTCHVVDRRGVADYACSCPLGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGHNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECVGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGDTCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCECLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVVAKPEMAALGGGGRLAFETGPPRLSHLPVASGTSTVLGSNSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 20 - protein, 2548 aa, Cavia porcellus
MLRAPGAPCWCRLLLYAPAARGLRCSQPGTCENGGRCEVLNGTEACICSGDFVGQRCQDPNPCLSAPCKNAGTCHMVDQGGTVDYTCSCSLGFSGPLCLTPLDNACLSGPCRNGGTCDLLTLTEYKCRCPPGWSGKSCQQADPCASNPCANGGHCLPFESTYICGCRPGFHGSTCRQDVNECSQTPGLCRNGGTCHNEVGSYRCACRPTHMGSNCELPYVPCSPSPCQNGGTCRPTGETTHECACLPGFTGQNCEDNVDDCPGNSCRNGGACVDGVNTYNCRCPPEWTGQFCTEDVDECQLMPNACQNGGTCHNTQGGYNCVCVNGWTGEDCSENIDDCASAACFNGATCHDRVASFYCECPHGRTGLLCHLNDACISNPCNEGSNCDTNPVNGKAICTCPSGYTGPACSQDVDECALGANPCEHAGKCINTLGSFECQCLQGYSGPRCEIDVNECISNPCQNDATCLDQIGEFQCICMPGYEGLYCEVNTDECASSPCLHNGRCLDRVSEFLCECPTGFSGHLCQYDVDECASTPCRNGAKCLDGPNTYSCVCTEGYTGIHCEVDINECDPDPCHYGSCKDGVAAFTCLCQPGYTGHHCETNINECASQPCRHGGTCQDRDNAYLCLCLKGTTGPNCEINLDDCASSPCDAGTCLDKIDGYECACEPGYTGSMCNINIDECAGSPCHNGGTCEDGINSFTCRCPEGYHDPTCLSEVNECSSNPCIHGSCQDSLNGYWCDCDSGWSGTNCDINNNECESNPCVNGGTCRDMTSGYVCTCREGFSGPNCQTNINECASNPCLNQGTCIDDVAGYKCNCLLPYTGTTCEVVLAPCAPSPCKNSGVCRESEDYESFSCICPSGWQGQTCEVDINECVKSPCRHGASCQNTNGDYRCHCQAGYTGRDCETDVDDCRPNPCHNGGSCTDGVNTAFCDCLPGFQGAFCEEDINECASSPCRNGANCTDCVDSYTCTCPAGFNGIHCENNTPDCTESSCFNGGTCVDGINSFTCLCPPGFTGSYCQHDINECDSRPCLNGGTCQDSYGTYKCTCPQGYTGLNCQNLVRWCDSSPCKNGGQCWQTSTLYRCECHSGWTGLYCDVPSVSCKVAAQQRDIDVAYLCQHGGLCVDAGNTHHCRCQAGYTGSYCEEEVDECSPSPCQNGATCTDYLGGYSCKCVAGYHGTNCSEETNECLSQPCQNGGTCIDLTNTYKCSCPRGTQGVHCEINVDDCSPLHDLASRSPKCFNNGTCVDQVGGYTCTCPPGFVGERCEGDVNECLSNPCDARGTQNCVQRVNDFHCECRAGHTGRRCESVIDGCKGKPCRNGGVCAVATNTARGFICRCPAGFEGATCENDARTCGSLRCLNGGTCISGPRSPTCLCLGAFTGPECQFPASSPCMGDNPCYNQGTCEPTAESPFYRCLCPAKFNGLQCHILDYSFVGGAGRDIPPPEVEEACELPECQEDAGNKVCSLQCNNHACGWDGGDCSLNFNDPWKNCSQSLQCWKYFSDGRCDSQCNSAGCLFDGFDCQHAEGQCNPLYDQYCKDHFSDGHCDQGCNSAECEWDGLDCAEHVPERLAAGTLVVVVLLPPEQLRNNSFHFLRELSRVLHTNVVFKRDAQGQQMIFPYYGREEELRKHPIKRSAPGWATPGSLLGQAAASLLTSEGPGRQRRELDPMDIRGSIVYLEIDNRQCVQLSSQCFQSATDVAAFLGALASLGSLNIPYKIEAVQSETVEPPPPSQLHLMYLIGAAFVLLFFVGCGVLLSRKRRRQHGQLWFPEGFKVSEASKKKRREPLGEDSVGLKPLKNVSDGALMDDNQNEWGDEDLEAKKFRFEEPVVLPDLDDQTDHRQWTQQHLDAADLRVSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAALVLLKNGANKDMQNNKEETPLFLAAREGSYETAKVLLDHFANRDITDHMDRLPRDIAQERMHHDIVRLLDEYNLVRSPQLHNAALGSTPTLSPTLCSPNGYLGNLKPAMQGKKARKPSTKGLACGSKEAKDLKARRKKSQDGKGCLLDSSSMLSPVDSLESPHGYLSDVASPPLLPSPFQPSPSLPLSHLPGMPDAHLGINHLNVTAKPEMAALGGGSRLFEPGPPRLSHLPVASSTSTVLGASSSGAVNFTVGTAAGLNGQCDWLSRLQNGMVSGQYNPLRGAVAPGTLSTQAPTLQHGMMGPLQSGLSTNTLSQMMNYQGLPSTRLATQPHLVQAQQVQPPNLQPPPNIQQPQSLQPQLPPSQPHLGVGSVANGHLGRSFMGGEPSQADVQPLGPNSLTVHTILPQEGQNLPTSMPSSLVPPMTTAQFLTPPSQHSYSSSPVDNTPSHQLQVPEHPFLTPSPESPDQWSSSSPHSNISDWSEGISSPPTSMQSQITHIPEAFK

SEQ ID NO: 21 - protein, 2555 aa, Chlorocebus sabaeus
MPPLLAPLLCLAFFPALAARGPRCSQPGETCLNGGKCEAANGTEACVCGGAFVGPRCQDPNPCLSNPCKNTGTCHVVDRGGVADYACSCPLGFSGPLCLTPLDNACLTNPCRNGGTCDLLTLTEYKCRCPPGWSGKSCQQADPCASNPCANGGQCLPFEASYICHCPPSFHGPTCRQDVNECGQNPGLCRHGGTCHNEVGSYRCVCRATHTGPNCERPYVPCSPSPCQNGGTCRPTGDVTHECTCLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGHCLDKINEFQCECPTGFTGHLCQYDVDECASTPCKNGAKCLDGPNTYTCVCTEGYTGMHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNVNIDECAGNPCHNGGTCQDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRESEDYESFSCVCPTGWQGQTCEVDINECVMSPCRHGASCRNTHGGYRCHCQAGYSGRNCETDIDDCRPNPCHNGGSCTDGINTAFCDCLPGFQGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECLPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPQIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGHEEELRKHPIKRAAEGWATPEALLGQVKASLLPGGSGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGATLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMATLGGGGRLAFEAGPPRLSHLPVASSTSTILGCSSGGAMNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPPNIQQQQNLQPPPPPPQPHLGVSSAASGHLGRSFLGGEPSQADVQPLGPSSLAVHTILPQESPALPTSLPSSLVPPVTAAQFLTPPSQHSYSSSPVDNTPSHQLQVPEHPFLTPSPESPDQWSSSSPHSNVSDWSEGVSSPPTSMQSQIARIPEAFK

SEQ ID NO: 22 - protein, 2555 aa, Canis lupus familiaris
SPLLCLILRVPASTGLRCSQPSESCLNGGKCEVFLNGTEACVCSGAFVGQRCQAPNPCLSAPCKNAGTCHTVDRGGLVDYACTCRLGFSGPLCLTPRDNACLSTPCRNGGTCDLLTLTEYKCRCPPGWSGKTCQQADPCASNPCANGGQCLPFEASYICGCPPGFHGPTCRQDVNECSQSPGLCQNGGTCHNEVGSYRCTCRATHTGPHCELPYVPCSPSPCQNGGTCRPTGDTTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECISNPCQNDATCLDQIGEFQCICMPGYEGVHCEVNTDECASSPCLQNGRCLDKINEFLCECPTGFTGHLCQYDVDECASTPCKNGAKCLDGPNTYSCMCTEGYTGLHCEVDIDECDPDPCHYGVCKDGVATFTCLCQPGYTGHHCESNINECHSQPCRHGGTCQDRDNAYLCSCLKGTTGPNCETNLDDCASSPCESGTCLDRIDGYECACEPGYTGSMCNVNIDECAGNPCHHGGTCEDGINSFMCRCPEGYHGPTCLSEVNECSSNPCIHGACRDSLNGYKCDCDPGWSGANCDVNNNECESNPCANGGACRDMTSGYVCTCREGFSGPNCQTNINECASNPCLNQGSCIDDVAGYKCNCPLPYTGATCEVVLAPCAPSPCRNGGACKESEDYESFSCICPTGWQGQTCEVDINECVKTPCRNGASCQNTNGGYRCHCRAGYTGRNCETDVDDCRPNPCHNGGSCTDGVNTAFCDCLPGFQGPFCEEDINECASNPCRHGANCTDCVDSYTCTCPTGFSGIHCENNTPDCTESSCFNGGTCVDGINSFTCLCPPGFTGSYCQHDINECDSRPCLHGGTCQDSYGTYRCTCPQGYTGLNCQNLVRWCDSSPCKNGGKCWQSNTLYRCECHSGWTGLYCDVPNVSCEVAAQRQDVNVTHLCRNGGLCMDAGNTHHCRCQAGYTGSYCEDQVDECSPSPCQNGATCTDYPGGYSCECVAGYHGVNCSEEMNECLSHPCQNGGTCIDLINTYKCSCPRGTQGVHCEVNVDDCSPPIDPVSRGPKCFNNGTCVDQVGGYSCTCPPGFVGERCEGDVNECLSNPCDIRGTQNCVQRVNDFYCECRAGHTGRRCESIINGCKGRPCQNGGTCAVASNTARGFICKCPAGFEGATCENDARACGSRRCLNGGTCISGPRSPTCLCLGPFTGPECQFPAGSPCVGGNPCYNQGSCEPTTESPFYRCLCPANFNGLLCHILDYSFGGGLGLDIPPPQIEEACELPECHEEAGNKVCSLACNNHACGWDGGDCSLNFNDPWQNCSQSLQCWKYFSNGHCDSQCNSAGCLFDGFDCQRAEGQCNPLYDQYCKDHFGDGHCDQGCNSAECEWDGLDCAEHVPERLAAGALVLVVLTPPAQLRNNSLHFLRELSRLLHTNVVFKRDAHGQPMIFPYYGREEELRKHPIKRAVDSWAVPGALLNRVEAALLPGGAGRRRRELDPMDIRGSIVYLEIDNRQCVQSSSQCFQSATDVAAFLGALASLGSLNIPYKIEAVQSETVELPPPPQLHFMYVAVAAFVLLFFVGCGVLLSRKRRRQHGQLWFPEGFKVSEASKKKRREPLGEDSVGLKPLKNVSDGALMDDNQNEWGDEDLEAKKFRFEEPVVLPDLDDQTDHRQWTQQHLDAADLRVSAMAPTPPQGEADADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYSLVRSPQLHGPALGGTPTLSPPLCSPNGYLGNLKPSVPGKKARKPSTKGLACGGKETKDLKARRKKSQDGKACLLDSSSVLSPVDSLESPHGYLSDVASPPLLSSPFQPSPSVPLGHLPGMPDAHLGVSHLSVAAKPEMATLAGGGRLAFEAGPPRLSHLPVASSTGTVLGTGSGSTSGSGGGAVNFTMGGATALNGQCEWLSRLQNGLVPNQYNPLRGNVAPGPLSSQAPGLQHSLMGPLHAGLPTTAALSHMMSYQALPNTRLASQPHLVQTQPLQQVPQQQQNLQPPTIQQPQSLPPPPQPPQPHLGVSSAASGHVGRSFLGGEPSQADVQPLGASGLAVHTILPQDSQALPTALPAALAPAMTTAQFLTPPSQHSYSSSPADNTPSHQLQVPEHPFLTPSPESPDQWSSSSPHSHVSDWSEGISSPPTSTQSHIAHIPETLK

SEQ ID NO: 23 - protein, 2174 aa, Felis catus
GFTGQNCEENIDDCPGNSCKNGGTCVDGVNTYNCRCPPEWTGQYCTEDVDECQLMPNACQNGGTCHNTHGGYNCVCVNGWTGEDCSENIDDCASAACFHGATCHDRVASFYCECPHGRTACHLNDACISNPCNEGSNCDTNPVNGKAICTCPSGYTGPACSQDVDECSLGANPCEHAGKCINTLGSFECQCLQGYTGPRCEIDVNECISNPCQNDATCLDQIGEFQCICMPGYEGVHCEVNTDECASSPCLQNGRCLDKINEFLCECPTGFTGHLCQYDVDECASTPCRNGAKCLDGPNTYTCVCTEGYTGPHCEVDIDECDPDPCHYGSCKDGVATFTCLCRPGYTGHHCETNVNECHSQPCRHGGTCQDRDNAYLCLCLKGTTGPNCETNLDDCASSPCDSGTCLDKIDGYECSCEPGYTGSMCNVNIDECAGNPCHHGGTCEDGTNSFTCRCPEGYHGPTCLSEVNECSSNPCIHGACRDSLNGYTCDCDPGWSGAHCDINTNECESNPCANGGACRDMTSGYVCTCREGFSGPNCQTNINECASNPCLNQGSCIDDVAGYTCNCPLPYTGATCEVVLAPCAPGPCRNGGECRESEDFESFSCVCPAGWQGQTCEVDINECVKNPCRHGASCQNTNGGYRCRCRAGYTGHNCETDVDDCRPNPCHNGGSCTDGVNTAFCDCLPGFRGAFCEEDINECASNPCHHGANCTDCVDSYTCTCPTGFSGIHCENNTPDCTESSCFNGGTCVDGISSFTCLCPPGFTGSYCQHDVNECDSRPCLHGGTCQDSYGTYKCTCPQGYTGLNCQNLVRWCDSSPCKNGGKCWQTNTLYRCECHSGWTGLYCDVPNVSCEVAARRRDINVTHLCRNGGLCMDAGNTHHCRCQAGYTGSYCEDQVDECSPSPCQNGATCTDYPGGYSCECVAGYHGVNCSEEINECLSHPCQNGGTCIDLINTYKCSCPRGTQGVHCEVNVDDCSPLIDPVSRGPKCFNNGTCVDQVGGYSCTCPPGFVGERCEGDVNECLSNPCDARGTQNCVQRVNDFYCECRAGHTGRRCESVINGCKGRPCQNGGTCAVASNTARGFICKCPAVEGGAWLEPGLASLLTDRECFQSSRSPTCLCLGLHGPECQFPAGSPCVGGNPCYNQGSCEPVPESPFYRCLCPAKFNGLLCHILDYSFGGGLGVDISPPQIEEACELPECREEAGNKVCSLGCNNHACGWVGGRFEGCLGSTCRGLGLLGWRQSTLPHTHTPPPTPQVILYRPGSLQPKTALPFWEHLPPSGPRLSQRGKLGGCRAYTCGLSPLRSIVYLEIDNRQCVQSSSQCFQSATDVAAFLGALASLGSLNIPYKIEAVQSETVEPPPPPQLHFMYVAVAAFVLLFFVGCGVLLSRKRRRQHGQLWFPEGFKVSEASKKKRREPLGEDSVGLKPLKNASDGALMDDSQHEWGDEDLEAKKFRFEEPVVLPDLDDQADHRQWTQQHLDAADLRVSAMAPTPPQGEADADSMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLVNSHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYGLARSPQLHGTALGGAPTLSPPLCSPGSYLGNLKPAVQGKKARKPSTKGLACGGKEAKDLKARRKKPQDGKGCLLDGSSVLSPVDSLESPHGYLSDVASPPLLPSPFQQSPTVPLNHLPGMPDAHLGVGHLSVAAKPEMAGLGGGGRLAFEAGPPRLSHLPVASSTSTVLGAGGGVNFTAGGAAGLNGQCEWLSRLQNGLVPNQYNPLRGNVAPGTLSTQAPALQHSMMGPLHAGLSTAALSQMMSYQALPSTRLAGQPHLVQTQQLPQVQPPQQNLQMQPPNLQPQPPQPHLGVASAAGGHVGRSFLGGEPSQADVQPLGPGGGLAVHTILPQDSQALPATLAPPMTTAQFLTPPSQHSYSSSPADNTPSHQLQVPEHPFLTPSPESPDQWSSSSPHSHVSDWSEGISSPPTSTQSHIAHIPEALK

SEQ ID NO: 24 - protein, 2524 aa, Equus caballus
CSQPGESCLNGGKCEVLANGTEACICSGAFAGQRCQVPNPCLSAPCKNGGTCHMVDRGGLVDYACSCSLGFSGPLCLTPQDNACLANPCRNGGTCDLLTLTDYKCRCPPGWSGKTCQQADPCASNPCANGGQCLPFEASYICGCPPGFHGPTCKQDINECSQSPGLCRNGGTCHNEVGSYRCACRATHTGPHCELPYVPCSPSPCQNGGTCRPTGDTTHECACLPGFTGQNCEENIDDCPGNSCKNGGACVDGVNTYNCRCPPEWTGMYCTEDVDECQLMPNACQNGGTCHNSHGGYNCVCVNGWTGEDCSENIDDCASASCFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLQNGRCLDKINEFLCECPTGQAGHLAAYAHWGCPSLPCPPGLSLRGGPVCHRGGPGAHQAHRHCRSEPWASRDDGVATFTCLCRPGYTGHHCETNINECHSQPCRHGGTCQDRDNAYLCFCLKGTTGPNCEINLDDCASNPCDSGTCLDKIDGYECACEPGYTGSMCNINIDECAGNPCHNGGTCEDGINGFTCRCPEGYHDPTCLSEVNECNSDPCIHGACRDSLNGYKCDCDPGWSGANCDINNNECESNPCVNGGTCKDMTSGYVCTCREGFSGPNCQTNINECASNPCLNQGTCIDDVAGYKCNCLLPYTGATCEVVLAPCAPGPCRNGGECRESEDFESFSCVCPVGWQGQTCEIDINECVKSPCRHGASCQNTNGGYRCHCQAGYTGRNCETDIDDCRPNPCHNGGSCTDGINAAFCDCLPGFQGAFCEEDINECASSPCRNGANCTDCVDSYTCTCPPGFGGIHCENNTPDCTESSCFNGGTCVDGINSFTCLCPPGFTGSYCQHDVNECDSRPCLHGGTCQDSYGTYKCTCPQGYTGLNCQSLVRWCDSSPCKNGGKCWQTNALYRCECHSGWTGLYCDVPSVSCEVAARLQDVNVSRLCRNGGLCENEGSTHHCHCQAGYTGSYCEDQVDECSPSPCQNGATCTDYPGGYSCECVAGYHGVNCSEEINECLSHPCQNGGTCIDLTNSYKCSCPRGTQGVHCEINMDDCTPPVDPVSRGPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICRCPAGYEGATCENDARACGSLRCLNGGTCISGPRSPTCLCLGPFTGPECQFPASSPCVGGNPCYNQGTCEPTSESPFYRCLCPAKFNGLLCHILDYSFGGGVGLDIPPPQIEEACELPACREEAGNKVCSVRCNNHACGWDGGDCSLNFNDPWQNCTQSLQCWKYFSNGHCDSQCNSAGCLFDGFDCQRAEGQCNPLYDQYCKDHFSDGHCDQGCNSAECEWDGLDCAEHVPERLAAGTLVVVVLMPPEQLRNNSFHFLRELSRLLHTNVVFKRDASGQQMIFPYYGREEELRKHPIRRSVDGWATPGSLLGHMKASLLPGSGGGRQRRELDPMDIRGSIVYLEIDNRQCVQSSSQCFQSTTDVAAFLGALASLGSLNIPYKIEAVQSESVEPPPPPPLHFMYVAVAAFVLLFFVGCGVLLSRKRRRQHGQLWFPEGFKVSEASKKKRREPLGEDSVGLKPLKNASDGALMDDNQNEWGDEDLETKKFRFEESVVLPDLDDQTDHRQWTQQHLDAADLRVSAMAPTPPQGEADTDCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVEAAIVLLKNGANKDMQNNKEETPLFLAAREGSYETAKVLLDHFANRDITDHMDRLPRDIAQERMHHDIVRLLDEYSLVRSPQLHGATLGGTPTLSPPLCSPNGYLGNLKPTVQGKKARKPSTKGLACGGKEAKDLKARRKKSQDGKGCLLDSSSVLSPVDSLESPHGYLSDVASPPLLPSPFQQSPSVPLNHLPGMPDTHLGVSHLSVAAKPEMATLGGGGRLAFEAGPPRLSHLPVASSTSTVLGPGGGSGVMNFTVGGATGLNSQCEWLSRLQNGLVPNQYNPLRGSVAPSTLSTQAPALQHGMMGPMHGGLSASALSQMMSYQALPNTRLATQPHLVQTQQLQQQQQQQQPQQNLQPPNIQPQQNLQPQPPPPHLGVSSAANGHMGRSFLGGEPSQADVQPLGPSSLAVHTILPQDSQVLPTSLPSSLAPPMTTAQFLTPPSQHSYSSSPVDNTPSHQLQVPEHPFLTPSPESPDQWSSSSPHSNISDWSEGISSPPTSMQSQIAHIPEAFK

SEQ ID NO: 25 - protein, 2008 aa, Ovis aries
  misc_feature (225)..(225): Xaa can be any naturally occurring amino acid
PPAPPGKTCQQADPCASNPCANGGQCLPFEASYICHCPPGFHGPTCRQDVGGGGGAAEVGRAGGGEGEGGGLPPCLRLCFWEVWGPHLHTHPTPDYLPGSLCLPAPVPCEGAPRPSAAPSNGVSTAARFTGQNCEENIDDCPGNSCKNGGACVAGVTPYNCRCPPEWTGVHSGRRRGHLCPWSLSPWGAGRREEGCCDLQLTAPLPGSEAPPKPPGAAQTWVAPXGVRLPRCPLPPCPGLLCHLNDACISNPCNEGANCDTNPVNGKAICTCPSGYTGPACSQDVDECSLGTGSQGAGEPVGSRPMGGGGSDGGGRHTPACSRGSNPCQNDATCLDQIGEFQCICMPGYEGLHCEVNTDECASSPCLQNGRCLDKINEFVCECPTGFTGHLCQYDVDECASTPCKNGAKCLDGPNTYSCMCTEGYTGPHCEVDIDECDPDPCHYGSCKDGVATFSCLCQPGYTGHHCETNINECHSQPCRHGGSCRMSEQERVTSSGLPPPGPNCEINLDDCASNPCDSGTCLDKIDGYECACEPGYTGSMCNINIDECADSPCHNGGTCEDGINGFTCRCPEGYHDPTCLSEVNECSSNPCIHGACRDSLNGYKCDCDPGWSGANCDVNNDECESNPCVNGGACKDMTSGYVCACREGFSGPNCQTNINECASNPCLNQGTCIDDVAGYKCNCLLPYTGMGGAWGCELGAWRAGAGPGQVGGLAGGGGPGSWCPAVCPRPRPPRRATRCALMVEPPVDGGCRGLCQDLPGALASGRGSRRAHHSASPSQETDPCHNGGSCTDGINTAFCDCLPGFQGAFCEEDINECASSPCRNGANCTDCVDGYTCTCPTGFSGIHCENNTPDCTESSCFNGGTCVDGINSFTCLCPPGFTGSYCQHCDSRPCLHGGTCQDSYGAYKCSCPQGYTGLNCQTLVRWCDSSPCKNGGRCWQTNALYRCECHSGWAGPFCDVPSVSSAVAPPEQSVNVTHLCRNGGLCMNAGNTHHCHCQAGYTGSYCEEQVDECSPSPCQNGATCTDYPGGYSCECVPGYHGVNCSEEVNECLSQPCRHGGTCIDLTNTYKCSCPRGTQGVHCEINVDDCNPPIDPVSRGPKCFNNGTCVDQVGGYSCTCPPGFVGERCEGDVNECLSNPCDARGTPACQPLTCLPTSDLLADPCPALCSPRRQVRPALGSRGEQCGGCCRAAEERGQQGHAEQQGGLAGETLPLSHSFPTGGPPSHDLSFGPRLPNPLSPRRSCGKTETWVLVWLALPASLWGHTPPPPGSRARAAAAVHPPPCHCDLRPHLYPWLSLAGTGQMVHAEPRGWWAGWGVLRCQAPRWNGECPPSTRGPPLVSLSLAAICPQSLSMLFLSCPVSCACLWAPVSPDPPLPSLTPEGISYSGGGAQGMLLGPVTSVCHGAEASSRLLLGRQGDWRQGPPGRGGRGRQRHRWARQTPPTQTPSSLTPHSSLGGAYVACPLYRPTDAHRHTLVTPQPLKLWQGLHLCGFGGGEGGTHSNIGSHRSSGWVLEDAFKVFLFVRRNSDGRTLGGELRVEAGSGVEAGLTAGPSAAPAPICSPQEETPLFLAAREGSYETAKVLLDHFANRDITDHMDRLPRDIAQERMHHDIVRLLDEYSLVRSPPLHGATLGGAPTLSPPLCSPNGYLGNLKPPMQGKKARKPSTKGLACGGKEPKDLKARRKKSQDGKGCLLDSGSVLSPVDSLESPHGYLGGSRLAFEAGPPRLSHLPVASSTSTILGAGGSGGGGAVNFTVGGAAGLNGQCEWLSRLQNGLVPNQYNPLRGGVTPGTLSTQAAGLQHGTVGPLHAPALSQVMSYQALPNTRLASQPHLVQTQQLQPQQNLQMQPPSMPPQPNLQPPQPHLGVSSAASGHLGRSFLGGELSQADMQPLGPGNLAAHTVLPQDGQVLPTSLPSTLAPPTLAPPMTTAQFLTPPSQHSYSSSPVDNTPSHQLQVPEHPFLTPSPESPDQWSSSSPHSNISDWSEGISSPPTSVPSQIAHVPEAFK

SEQ ID NO: 26 - protein, 2437 aa, Danio rerio
MNRFLVKLTLLTAASLATVAQGQRCSEYCQNGGICEYKPSGEASCRCPADFVGAQCQFPNPCNPSPCRNGGVCRPQMQGNEVGVKCDCVLGFSDRLCLTPVNHACMNSPCRNGGTCSLLTLDTFTCRCQPGWSGKTCQLADPCASNPCANGGQCSAFESHYICTCPPNFHGQTCRQDVNECAVSPSPCRNGGTCINEVGSYLCRCPPEYTGPHCQRLYQPCLPSPCRSGGTCVQTSDTTHTCSCLPGFTGQTCEHNVDDCTQHACENGGPCIDGINTYNCHCDKHWTGQYCTEDVDECELSPNACQNGGTCHNTIGGFHCVCVNGWTGDDCSENIDDCASAACSHGATCHDRVASFFCECPHGRTGLLCHLDDACISNPCQKGSNCDTNPVSGKAICTCPPGYTGSACNQDIDECSLGANPCEHGGRCLNTKGSFQCKCLQGYEGPRCEMDVNECKSNPCQNDATCLDQIGGFHCICMPGYEGVFCQINSDDCASQPCLNGKCIDKINSFHCECPKGFSGSLCQVDVDECASTPCKNGAKCTDGPNKYTCECTPGFSGIHCELDINECASSPCHYGVCRDGVASFTCDCRPGYTGRLCETNINECLSQPCRNGGTCQDRENAYICTCPKGTTGVNCEINIDDCKRKPCDYGKCIDKINGYECVCEPGYSGSMCNINIDDCALNPCHNGGTCIDGVNSFTCLCPDGFRDATCLSQHNECSSNPCIHGSCLDQINSYRCVCEAGWMGRNCDININECLSNPCVNGGTCKDMTSGYLCTCRAGFSGPNCQMNINECASNPCLNQGSCIDDVAGFKCNCMLPYTGEVCENVLAPCSPRPCKNGGVCRESEDFQSFSCNCPAGWQGQTCEVDINECVRNPCTNGGVCENLRGGFQCRCNPGFTGALCENDIDDCEPNPCSNGGVCQDRVNGFVCVCLAGFRGERCAEDIDECVSAPCRNGGNCTDCVNSYTCSCPAGFSGINCEINTPDCTESSCFNGGTCVDGISSFSCVCLPGFTGNYCQHDVNECDSRPCQNGGSCQDGYGTYKCTCPHGYTGLNCQSLVRWCDSSPCKNGGSCWQQGASFTCQCASGWTGIYCDVPSVSCEVAARQQGVSVAVLCRHAGQCVDAGNTHLCRCQAGYTGSYCQEQVDECQPNPCQNGATCTDYLGGYSCECVPGYHGMNCSKEINECLSQPCQNGGTCIDLVNTYKCSCPRGTQGVHCEIDIDDCSPSVDPLTGEPRCFNGGRCVDRVGGYGCVCPAGFVGERCEGDVNECLSDPCDPSGSYNCVQLINDFRCECRTGYTGKRCETVFNGCKDTPCKNGGTCAVASNTKHGYICKCQPGYSGSSCEYDSQSCGSLRCRNGATCVSGHLSPRCLCAPGFSGHECQTRMDSPCLVNPCYNGGTCQPISDAPFYRCSCPANFNGLLCHILDYSFSGGQGRDIAPPVEVEIRCEIAQCEGRGGNAICDTQCNNHACGWDGGDCSLNFDDPWQNCSAALQCWRYFNDGKCDEQCATAGCLYDGFDCQRLEGQCNPLYDQYCRDHYADGHCDQGCNNAECEWDGLDCADDVPQKLAVGSLVLVVHIPPDELRNRSSSFLRELSSLLHTNVVFRRDANGEALIFPYYGSEHELSKHKRSDWTDPGQLMQRARRSLTSFLKPRTRRELDHMEVKGSIVYLEIDNRQCFQQSDECFQSATDVAAFLGALASSGNLNVPYIIEAVTSEGGPPKTGEMYPMFLVLLALAVLALAAVGVVVSRKRKREHGQLWFPEGFKVNEPKKKRREPVGEDSVGLKPLKNSDSSLMDEQLSEWAEDDTNKRFRFEGQSILEMSGQLDHRQWTQQHLDAADLRLNSMAPTPPQGQIENDCMDVNVRGPDGFTPLMIASCSGGGLENENGEAEEDPSADVITDFIYHGANLHNQTDRTGETALHLAARYARSDAAKRLLESCADANVQDNMGRTPLHAAVAADAQGVFQILIRNRATDLDARMHDGTTPLILATRLAVEGMVEELINCHADPNAVDDSGKSALHWAAAVNNVDAAVVLLKNGANKDLQNNKEETPLFLAAREGSYETAKVLLDHLANRDIADHLDQLPRDIAHERMHHDIVRLLEEYNLVRSPPLPLSPPLCCPNTYLGIKPSPGNNNNTAKKTRKPGGKGVGGKDSGKDIRTKKKKSGDGKNGGIMEVGVLSPVDSLESPHGYLSDVSSPPMMTSPFQQSPPISLNQLQGLADSHMGGALQGLGKPFDSAPRLSHLPVANNVGGAQAGACDWLQRVQQQQQQQQQQQQAGMLMPTMLSATNMPQVMGYPTMQSSHLGAPSHMIAHQNMAPMQHQNISHHFLGDLSGLDLQSSSGHAPIQTILPQDSQRMAPPISSTQFLTPPSQHSYSNPMDNTPNHQQVPDHPFLTPSAGSPDQWSSSSPHSNLSDWSEGISSPPTSMQMNHIPEAFK

SEQ ID NO: 27 - protein, 2527 aa, Cricetulus griseus
  misc_feature (2298)..(2298): Xaa can be any naturally occurring amino acid
MGRSDSRAGALLEGGCEQNIDPRRAAHCHHPRLATSSLRCSQPSGTCLNGGRCEVANGTEACVCSGPFVGQRCQDPNPCLSTPCKNAGTCHVVEHGGTVNYACSCPLGFSGPLCLTPLDNACLANPCRNGGTCDLLTLTEYKCRCPPGWSGKSCQQADPCASNPCANGGQCLPFESSYICGCPPGFHGPTCRQDVNECSQNPGLCRHGGTCHNEIGSYRCVCRATHTGPHCELPYVPCSPSPCQNGGTCRPTGDTTHECACLPGFAGQNCEENVDDCPGNNCKNGGACVDGVNTYNCRCPPEWTGQYCTEDVDECQLMPNACQNGGTCHNTHGGYNCVCVNGWTGEDCSENIDDCASAACFQGATCHDRVASFYCECPHGRTGLLCHLNDACISNPCNEGSNCDTNPVNGKAICTCPSGYTGPACSQDVDECALGANPCEHAGKCLNTLGSFECQCLQGYTGPRCEIDVNECISNPCQNDATCLDQIGEFQCICMPGYEGVYCEINTDECASSPCLHNGHCMDKINEFLCQCPKGFSGHLCQYDVDECASTPCKNGAKCLDGPNTYTCVCTEGYTGTHCEVDIDECDPDPCHYGFCKDGVATFTCLCQPGYTGHHCETNINECHSQPCRHGGTCQDRDNSYLCLCLKGTTGPNCEINLDDCASNPCDSGTCLDKIDGYECACEPGYTGSMCNVNIDECAGSPCHNGGTCEDGIAGFTCRCPEGYHDPTCLSEVNECNSNPCIHGACRDGLNGYKCDCAPGWSGTNCDINNNECESNPCVNGGTCKDMTSGYVCTCREGFSGPNCQTNINECASNPCLNQGTCIDDVAGYKCNCPLPYTGATCEVVLAPCATSPCKNSGVCKESEDYESFSCVCPTGWQGQTCEIDINECVKSPCRHGASCQNTNGSYRCLCQAGYTGRNCESDIDDCRPNPCHNGGSCTDGINMAFCDCLPGFQGAFCEEDINECASNPCRNGANCTDCVDSYTCTCPAGFNGIHCENNTPDCTESSCFNGGTCVDGINSFTCLCPPGFTGSYCQYDVNECDSRPCLHGGTCQDSYGTYKCTCPQGYTGLNCQNLVHWCDSAPCKNGGKCWQTNTQYHCECRSGWTGFNCDVLSVSCEVAAQKRGIDVTLLCQHGGLCVDEEDKHYCHCQAGYTGSYCEDEVDECSPNPCQNGATCTDYLGGFSCKCVAGYHGSNCSEEINECLSQPCQNGGTCIDLTNTYKCSCPRGTQGVHCEINVDDCHPHLDPASRSPKCFNNGTCVDQVGGYSCTCPPGFVGERCEGDINECLSNPCDPRGTQDCVQRVNDFHCECRAGHTGRRCESVINGCRGKPCKNGGVCAVASNTARGFICRCPAGFEGATCENDARTCGSLRCLNGGTCISGPRSPTCLCLGSFTGPECQFPASSPCVGSNPCYNQGTCEPTSESPFYRCLCPAKFNGLLCHILDYSFTGGAGRDIPPPQIEEACELPECQEDAGNKVCNLQCNNHACGWDGGDCSLNFNDPWKNCTQSLQCWKYFSDGHCDSQCNSASCLFDGFDCQRTEGQCNPLYDQYCKDHFSDGHCDQGCNSAECDWDGLDCADHVPERLAAGTLVLVVLLPPEQLRNNSFHFLRELSHVLHTNVVFKRDAEGQQMIFPYYGHEEELRKHPIKRSAVGWTTSSLLPSTNGGRQRRELDPMDIRGSIVYLEIDNRQCVQSSSQCFQSATDVAAFLGALASLGNLNIPYKIEAVKSETVEPPLPSQLHLMYLAAAAFVLLFFVGCGVLLSRKRRRQHGQLWFPEGFKVSEASKKKRREPLGEDSVGLKPLKNASDGALMDDNQNEWGDEDLETKKFRFEEPVVVPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILLRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGTALGGTPTLSPTLCSPNGYLGNLKSATQGKKARKPSTKGLACGSKEAKDLKARRKKSQDGKGCLLDSSSMLSPVDSLESPHGYLSDVASPPLLPSPFQQSPSMPLSHLPGMPDTHLGISHLNVAAKPEMAALAGSSRLAFEPPPPRLPHLPVASSASTVLSTNGSXGEEEWLAPSQYNPLRPGVASGTLSTQAAGLQHGMMGPLHSSLSTNTLSPMIYQGLPNTRLATQPHLVQTQQVQPQNLQIQPQNLQPPSQPHLSVSSAANGHLGRSFLGGEHSQADVQPLGPSSLPVHTILPQESQALPTSLPSSMVPPMTTTQFLTPPSQHSYSSSPVDNTPSHQLQVPEHPFLTPSPESPDQWSSSSPHSNISDWSEGISSPPTSMPSQITHIPEAFK

SEQ ID NO: 28 - protein, 2524 aa, Xenopus laevis
MDRIGLAVLLCSLPVLTQGLRCTQTAEMCLNGGRCEMTPGGTGVCLCGNLYFGERCQFPNPCTIKNQCMNFGTCEPVLQGNAIDFICHCPVGFTDKVCLTPVDNACVNNPCRNGGTCELLNSVTEYKCRCPPGWTGDSCQQADPCASNPCANGGKCLPFEIQYICKCPPGFHGATCKQDINECSQNPCKNGGQCINEFGSYRCTCQNRFTGRNCDEPYVPCNPSPCLNGGTCRQTDDTSYDCTCLPGFSGQNCEENIDDCPSNNCRNGGTCVDGVNTYNCQCPPDWTGQYCTEDVDECQLMPNACQNGGTCHNTYGGYNCVCVNGWTGEDCSENIDDCANAACHSGATCHDRVASFYCECPHGRTGLLCHLDNACISNPCNEGSNCDTNPVNGKAICTCPPGYTGPACNNDVDECSLGANPCEHGGRCTNTLGSFQCNCPQGYAGPRCEIDVNECLSNPCQNDSTCLDQIGEFQCICMPGYEGLYCETNIDECASNPCLHNGKCIDKINEFRCDCPTGFSGNLCQHDFDECTSTPCKNGAKCLDGPNSYTCQCTEGFTGRHCEQDINECIPDPCHYGTCKDGIATFTCLCRPGYTGRLCDNDINECLSKPCLNGGQCTDRENGYICTCPKGTTGVNCETKIDDCASNLCDNGKCIDKIDGYECTCEPGYTGKLCNININECDSNPCRNGGTCKDQINGFTCVCPDGYHDHMCLSEVNECNSNPCIHGACHDGVNGYKCDCEAGWSGSNCDINNNECESNPCMNGGTCKDMTGAYICTCKAGFSGPNCQTNINECSSNPCLNHGTCIDDVAGYKCNCMLPYTGAICEAVLAPCAGSPCKNGGRCKESEDFETFSCECPPGWQGQTCEIDMNECVNRPCRNGATCQNTNGSYKCNCKPGYTGRNCEMDIDDCQPNPCHNGGSCSDGINMFFCNCPAGFRGPKCEEDINECASNPCKNGANCTDCVNSYTCTCQPGFSGIHCESNTPDCTESSCFNGGTCIDGINTFTCQCPPGFTGSYCQHDINECDSKPCLNGGTCQDSYGTYKCTCPQGYTGLNCQNLVRWCDSSPCKNGGKCWQTNNFYRCECKSGWTGVYCDVPSVSCEVAAKQQGVDIVHLCRNSGMCVDTGNTHFCRCQAGYTGSYCEEQVDECSPNPCQNGATCTDYLGGYSCECVAGYHGVNCSEEINECLSHPCQNGGTCIDLINTYKCSCPRGTQGVHCEINVDDCTPFYDSFTLEPKCFNNGKCIDRVGGYNCICPPGFVGERCEGDVNECLSNPCDSRGTQNCIQLVNDYRCECRQGFTGRRCESVVDGCKGMPCRNGGTCAVASNTERGFICKCPPGFDGATCEYDSRTCSNLRCQNGGTCISVLTSSKCVCSEGYTGATCQYPVISPCASHPCYNGGTCQFFAEEPFFQCFCPKNFNGLFCHILDYEFPGGLGKNITPPDNDDICENEQCSELADNKVCNANCNNHACGWDGGDCSLNFNDPWKNCTQSLQCWKYFNDGKCDSQCNNTGCLYDGFDCQKVEVQCNPLYDQYCKDHFQDGHCDQGCNNAECEWDGLDCANMPENLAEGTLVLVVLMPPERLKNNSVNFLRELSRVLHTNVVFKKDSKGEYKIYPYYGNEEELKKHHIKRSTDYWSDAPSAIFSTMKESILLGRHRRELDEMEVRGSIVYLEIDNRQCYKSSSQCFNSATDVAAFLGALASLGSLDTLSYKIEAVKSENMETPKPSTLYPMLSMLVIPLLIIFVFMMVIVNKKRRREHGQLWFPDGFIPKEPSKKKRRDRLGEDSVGLKPIKNMTDGSFMDDNQNEWGDEETLENKRFRFEEQVILPELVDDKTDPRQWTRQHLDAADLRISSMAPTPPQGEIEADCMDVNVRGPDGFTPLMIASCSGGGLETGNSEEEEDASANMISDFIGQGAQLHNQTDRTGETALHLAARYARADAAKRLLESSADANVQDNMGRTPLHAAVAADAQGVFQILIRNRATDLDARMFDGTTPLILAARLAVEGMVEELINAHADVNAVDEFGKSALHWAAAVNNVDAAAVLLKNSANKDMQNNKEETSLFLAAREGSYETAKVLLDHYANRDITDHMDRLPRDIAQERMHHDIVHLLDEYNLVKSPTLHNGPLGATTLSPPICSPNGYMGNMKPSVQSKKARKPSIKGNGCKEAKELKARRKKSQDGKTTLLDSGSSGVLSPVDSLESTHGYLSDVSSPPLMTSPFQQSPSMPLNHLTSMPESQLGMNHINMATKQEMAAGSNRMAFDAMVPRLTHLNASSPNTIMSNGSMHFTVGGAPTMNSQCDWLARLQNGMVQNQYDPIRNGIQQGNAQQAQALQHGLMTSLHNGLPATTLSQMMTYQAMPNTRLANQPHLMQAQQMQQQQNLQLHQSMQQQHHNSSTTSTHINSPFCSSDISQTDLQQMSSNNIHSVMPQDTQIFAASLPSNLTQSMTTAQFLTPPSQHSYSSPMDNTPSHQLQVPDHPFLTPSPESPDQWSSSSPHSNMSDWSEGISSPPTSMQPQRTHIPEAFK

SEQ ID NO: 29 - protein, 2522 aa, Xenopus tropicalis
MYRIGLLVLIWSLLGLAQGLRCTQTAEMCLNGGRCEMTPGGTGVCLCSSSYFGERCQYPNPCALKNQCMNFGTCEPVLLGNAIDFTCHCPVGFTDKVCLTPVDNACVNNPCRNGGTCELLSSVSDYRCRCPPGWTGDSCQQADPCASNPCANGGKCLPFETQYICKCPSGFHGATCKQDINECSQNPCRNGGQCLNEFGSYRCNCQNRFTGRNCEEPYVPCNPSPCLNGGTCRQTDDTSYECTCLPGFSGQNCEENIDDCPSNNCRNGGTCVDGVNTYNCQCPPDWTGQYCTEDVDECQLMPNACQNGGTCHNTYGGYNCVCVNGWTGEDCSENIDDCANAACHSGATCHDRVASFFCECPHGRTGLLCHLDNACISNPCNEGSNCDTNPVNGKAICTCPPGYTGPACNNDVDECSLGANPCEHGGRCTNTLGSFQCNCPQGYAGPRCEIDVNECLSNPCQNDATCLDQIGEFQCICMPGYEGLYCETNIDECASNPCLHNGKCVDKINEFHCECPTGFNGNLCQHDVDECASTPCKNGAKCLDGPNSYTCQCTEGFTGRHCEQDINECIPDPCHYGTCKDGIATFTCLCRPGYTGRLCDNDINECLSQPCQNGGQCTDRENGYICTCPKGTTGVNCETNLDDCASNPCDYGKCIDKIDGYECTCEPGYTGKMCNINIDECASNPCRNGGTCKDKINGFTCVCPDGYHDHMCLSEVNECNSNPCIHGTCHDGINGYKCDCDAGWSGSNCDVNNNECESNPCMNGGTCKDMTGAYICTCRAGFSGPNCQTNINECASNPCLNRGTCIDDVAGYKCNCMLPYTGAICEAVLAPCSGSPCKNGGRCKESEDYETFSCECPPGWQGQTCEIDMNECVNRPCRNGAMCQNTNGSYKCNCKPGYAGRHCETDIDDCQPNPCHNGGSCSDGINMFFCNCPAGFRGPKCEEDINECASNPCKNGANCTDCVNSYTCTCQPGFSGIHCENNTPDCTESSCFNGGTCIDGINTFSCQCPPGFTGNYCQHDINECDSKPCLNGGTCQDSYGAYKCTCPQGYTGLNCQNLVRWCDSSPCKNGGKCWQTNNFYRCECKSGWTGVYCDVPSVSCEVAAKQQGVDIAHLCRNSGMCVDTGNTHFCRCQAGYTGSYCEEQVDECSPNPCQNGATCTDYLGGYSCECVAGYHGVNCSEEINECLSHPCHNGGTCIDLINTYKCSCPRGTQGVHCEINVDDCTPFYDSVSLEPKCFNNGKCFDRVGGYNCICPPGFVGERCEGDVNECLSNPCDPRGTQNCIQLVNDYRCECRQGFTGRRCDSVVDGCKGLPCRNGGTCAVASNTERGFICKCPPGFDGATCEYDARTCGNLRCQNGGTCISVLKSSKCVCSEGYTGATCQYPVVSPCASRPCYNGGTCQFSPEEPFFQCFCPTNFNGLFCHILDYGFIGGLGKNITPPDNEEICENEQCAELADNKICNANCNNHACGWDGGDCSLNFNDPWKNCTQSLQCWKYFNDGKCDSQCNNSGCLYDGFDCQKVEVQCNPLYDQYCRDHFQDGHCDQGCNNAECEWDGLDCDNMPENLAEGTLLIVVLMPPEKLKNNSVNFLRELSRVLHTNVVFKKDSKGEYKIYPYYGNEEELKKHHIKKRSAASWSDAPTAIFSTMKESVLPGRRRRELDQMEVRGSIVYLEIDNRQCYKSSSQCFTSATDVAAFLGALATHGNLNIPYKIEAVKSEIVETAKPPPPLYAMFSMLVIPLLIIFVIMVVIVNKKRRREHGQLWFPEGFIPKEPSKKKRREPLGEDSVGLKPLKNLTDGSFMDDNQNEWGDEETLENKRFRFEEQVMLPELVDDQTDHRQWTQQHLDAADLRIPSMAPTPPQGEIDADCMDVNVRGPDGFTPLMIAACSGGGLETGNSEEEEDASANMISDFIGQGAQLHNQTDRTGETALHLAARYARADAAKRLLESSADANVPDNMGRTPLHAAVAADAQGVFQILIRNRATDLDARMCDGTTPLILAARLAVEGMVEELINAHADVNAVDEFGKSALHWAAAVNNVDAAAVLLKSSANKDMQNNKEETPLFLAAREGSYETAKVLLDHYANRDITDHMDRLPRDIAQERMHHDIVHLLDEHNLVKSPTLHGGPLGAPTLSPPICSPNGYMGNMKPSVQSKKARKPSIKGNGCKEAKELKARRKKSQDGKTSLLDSGSSGVLSPVDSLESPHGYLSDVASPPLMTSPFQQSPSMPLNHLTSMQDSHLGLNHMTMANKQEMASNRMAFDGMTPRLTHLNVSSPNTIMTNGSMHFTVGGAPAMNGQCDWFARLQNGMVQNQYNPIRNGIQQGNAQQALQHGLMSSLHNGLPATTLSQMMTYQAMPNTRMANQPHLMQAQQMQQQQNLQLHQSVQQQQHQNSNATSTHIGSPFCSNDISQTDLQQMSGNNIHSVMPQDTQIFTNSLPPTLTQSMATTQFLTPPSQHSYSSPMDNTPSHQLQVPDHPFLTPSPESPDQWSSSSPHSNMSDWSEGISSPPTSMQPQRTHIPEAFK

SEQ ID NO: 30 - protein, 2703 aa, Drosophila melanogaster
MQSQRSRRRSRAPNTWICFWINKMHAVASLPASLPLLLLTLAFANLPNTVRGTDTALVAASCTSVGCQNGGTCVTQLNGKTYCACDSHYVGDYCEHRNPCNSMRCQNGGTCQVTFRNGRPGISCKCPLGFDESLCEIAVPNACDHVTCLNGGTCQLKTLEEYTCACANGYTGERCETKNLCASSPCRNGATCTALAGSSSFTCSCPPGFTGDTCSYDIEECQSNPCKYGGTCVNTHGSYQCMCPTGYTGKDCDTKYKPCSPSPCQNGGICRSNGLSYECKCPKGFEGKNCEQNYDDCLGHLCQNGGTCIDGISDYTCRCPPNFTGRFCQDDVDECAQRDHPVCQNGATCTNTHGSYSCICVNGWAGLDCSNNTDDCKQAACFYGATCIDGVGSFYCQCTKGKTGLLCHLDDACTSNPCHADAICDTSPINGSYACSCATGYKGVDCSEDIDECDQGSPCEHNGICVNTPGSYRCNCSQGFTGPRCETNINECESHPCQNEGSCLDDPGTFRCVCMPGFTGTQCEIDIDECQSNPCLNDGTCHDKINGFKCSCALGFTGARCQINIDDCQSQPCRNRGICHDSIAGYSCECPPGYTGTSCEININDCDSNPCHRGKCIDDVNSFKCLCDPGYTGYICQKQINECESNPCQFDGHCQDRVGSYYCQCQAGTSGKNCEVNVNECHSNPCNNGATCIDGINSYKCQCVPGFTGQHCEKNVDECISSPCANNGVCIDQVNGYKCECPRGFYDAHCLSDVDECASNPCVNEGRCEDGINEFICHCPPGYTGKRCELDIDECSSNPCQHGGTCYDKLNAFSCQCMPGYTGQKCETNIDDCVTNPCGNGGTCIDKVNGYKCVCKVPFTGRDCESKMDPCASNRCKNEAKCTPSSNFLDFSCTCKLGYTGRYCDEDIDECSLSSPCRNGASCLNVPGSYRCLCTKGYEGRDCAINTDDCASFPCQNGGTCLDGIGDYSCLCVDGFDGKHCETDINECLSQPCQNGATCSQYVNSYTCTCPLGFSGINCQTNDEDCTESSCLNGGSCIDGINGYNCSCLAGYSGANCQYKLNKCDSNPCLNGATCHEQNNEYTCHCPSGFTGKQCSEYVDWCGQSPCENGATCSQMKHQFSCKCSAGWTGKLCDVQTISCQDAADRKGLSLRQLCNNGTCKDYGNSHVCYCSQGYAGSYCQKEIDECQSQPCQNGGTCRDLIGAYECQCRQGFQGQNCELNIDDCAPNPCQNGGTCHDRVMNFSCSCPPGTMGIICEINKDDCKPGACHNNGSCIDRVGGFECVCQPGFVGARCEGDINECLSNPCSNAGTLDCVQLVNNYHCNCRPGHMGRHCEHKVDFCAQSPCQNGGNCNIRQSGHHCICNNGFYGKNCELSGQDCDSNPCRVGNCVVADEGFGYRCECPRGTLGEHCEIDTLDECSPNPCAQGAACEDLLGDYECLCPSKWKGKRCDIYDANYPGWNGGSGSGNDRYAADLEQQRAMCDKRGCTEKQGNGICDSDCNTYACNFDGNDCSLGINPWANCTANECWNKFKNGKCNEECNNAACHYDGHDCERKLKSCDSLFDAYCQKHYGDGFCDYGCNNAECSWDGLDCENKTQSPVLAEGAMSVVMLMNVEAFREIQAQFLRNMSHMLRTTVRLKKDALGHDIIINWKDNVRVPEIEDTDFARKNKILYTQQVHQTGIQIYLEIDNRKCTECFTHAVEAAEFLAATAAKHQLRNDFQIHSVRGIKNPGDEDNGEPPANVKYVITGIILVIIALAFFGMVLSTQRKRAHGVTWFPEGFRAPAAVMSRRRRDPHGQEMRNLNKQVAMQSQGVGQPGAHWSDDESDMPLPKRQRSDPVSGVGLGNNGGYASDHTMVSEYEEADQRVWSQAHLDVVDVRAIMTPPAHQDGGKHDVDARGPCGLTPLMIAAVRGGGLDTGEDIENNEDSTAQVISDLLAQGAELNATMDKTGETSLHLAARFARADAAKRLLDAGADANCQDNTGRTPLHAAVAADAMGVFQILLRNRATNLNARMHDGTTPLILAARLAIEGMVEDLITADADINAADNSGKTALHWAAAVNNTEAVNILLMHHANRDAQDDKDETPLFLAAREGSYEACKALLDNFANREITDHMDRLPRDVASERLHHDIVRLLDEHVPRSPQMLSMTPQAMIGSPPPGQQQPQLITQPTVISAGNGGNNGNGNASGKQSNQTAKQKAAKKAKLIEGSPDNGLDATGSLRRKASSKKTSAASKKAANLNGLNPGQLTGGVSGVPGVPPTNSAAQAAAAAAAAVAAMSHELEGSPVGVGMGGNLPSPYDTSSMYSNAMAAPLANGNPNTGAKQPPSYEDCIKNAQSMQSLQGNGLDMIKLDNYAYSMGSPFQQELLNGQGLGMNGNGQRNGVGPGVLPGGLCGMGGLSGAGNGNSHEQGLSPPYSNQSPPHSVQSSLALSPHAYLGSPSPAKSRPSLPTSPTHIQAMRHATQQKQFGGSNLNSLLGGANGGGVVGGGGGGGGGVGQGPQNSPVSLGIISPTGSDMGIMLAPPQSSKNSAIMQTISPQQQQQQQQQQQQQHQQQQQQQQQQQQQQQQQLGGLEFGSAGLDLNGFCGSPDSFHSGQMNPPSIQSSMSGSSPSTNMLSPSSQHNQQAFYQYLTPSSQHSGGHTPQHLVQTLDSYPTPSPESPGHWSSSSPRSNSDWSEGVQSPAANNLYISGGHQANKGSEAIYI

SEQ ID NO: 31 - protein, 2428 aa, Xenopus tropicalis
VHSSVVNLVARTVALAKLVANVRVLTINSCTVSCLTSWIGELCQFKDPCVPSPCINGGACQSSIRGGTVQYECSCAKGFREPSLLPPKRSVCWWVTCKSSGPLSHVACTPSPLPSVSSLGQDCSLIDACASNPCENGARCTNWNGRYNCTCPPGYQGRSCRVDIDECRTPGLCQNGGQCVNTPGSFRCRCPSGYTGQFCEAIYVPCAPSQCQNGGTCRQTGDLTYQCACLPGFEGPNCEINVDDCPGHKCMNGGTCVDGVNTYNCQCAPEWTGQYCTEDVDECQLQPNACHNGGTCFNTQGGHTCVCVNGWTGESCSENIDDCATAVCFNGATCHDRVASFYCECPMGKTGLLCHLEDACVSNPCHKDAMCDTNPVNGRAICTCPPGFTGGACDQDVDECSIGANPCEHFGRCVNTQGSFQCQCGRGYTGPRCETDVNECLSTPCQNDATCLDRIGEFTCICMAGFTGTFCELNINECESSPCVNGGVCKDVVNGFTCSCPAGFTGSMCQIDIDECASTPCKNGAKCVDRPNGYECRCAEGFEGPLCDRNIDDCSPDPCHHGKCRDGIASFTCTCEPGYTGYRCENQINECHSNPCMHGGKCIDLVNKYLCYCQQGTSGVHCEHNYDDCASNPCDYGECRDGINRYDCVCKAGFTGPLCNIEVSPCASNPCRAGGTCQVTQNGFRCLCPEGRGTRDFLCNPTQDPDKELCPPGCVHGVCRRLSDGYSCDCKVGWTGRMCDRRGSDVCTPNPCQNGGNCIDHQGVPICRCRDGFRGPTCMIDIDECASAPCLNGGKCMDGIAGYSCLCTLPYTGQKCETILDPCAPDPCHNGGICSPTPDYESHMCQCSPGWRGETCDDDIDECARSPCKNGGFCTNMQGGYSCACLSGFNGQDCETDINDCNPNPCLNGGACKDGINSFACSCIPGFTGSRCTDEINECLSNPCRNGATCKDYVNSYVCSCAPGYTGPICETNIQDCTESSCFNGGTCVDGVNSYTCRCRPGFTGSHCQNEVDECASRPCQNGAMCVDGVESYRCICPYGYTGAQCQNLVDLCRRSPCQNGGRCTQTGPSFRCECPAGWAGSYCDVPRVSCEVAAARRNVRADQLCHSGGICMNAGSSHHCICRGGYTGSYCENPINQCDPDPCHNGGACHSYLGGYVCECPSGYEGKNCEYDINECQSHPCQNGGTCIDLIGRYICSCPPGTLGVLCEINEDDCSPLSISGPPKCLNNGTCIDKVGGYRCNCPPGYTGERCEGDINECLSGPCHAQNTRHCVQLANDYQCVCKSGYTGRRCQSVMNTCESRPCQNGGVCSVTVNTPLGYTCRCPLGFTGPSCERPPLSCRELSCPSGSTCLPPPLGPRCICPPGVLCRTPNNSSAPTPAPLPCSNSPCRNGATCIPNIHFPYYQCKCHPGMIGPRCDIRTPRILTQTPAPGCTPSHCPGKAGDGHCDRECNVAACKWDGGDCSLSVDDPWRNCPRQECRSLFNNSQCDKECTSADCLYDNFDCRGREERSCNPVYEKYCMDHYGDGRCDKGCNSEECGWDGLDCAKNSDKEVLADGVLVVVVLVPPNEFLKQSTAFLQRLSSLLHTSLRFCTDSNGNYKIKPYRKSQTWDGRKKRELDSDIIGSEVMLEIDNRICVKEMPDCFPNTETAARFLAALSVLERLQFPYPIKAVRSEKIEEVIDNFRFLPLFAVAGVLILIVAVLGVIVSRRKRAHSTLWFPEGFILKKERDRREPVGQDALGLKNIAKAERLMEDPSEDWTETDCPETKKLKTEELSPCRQDPVDPRPWTQHHLAAADIRLPPATALTPPQGDYESDGMDVNVRGPDGFTPLMLASFLGGGLEPESQEEEEEGEASAITDLICQGASLGAQTDRTGETALHLAARYARADAAKRLLDAGADPNAQDHTGRTPLHAAVAADAQGVFQILIRNRSTDLDARMGDGSTALILAARLAVEGMVEELITCHADVNAVDELGKSALHWAAAVNNIEATLALLKNGANKDMQDSKEETPLFLAAREGSYEAAKVLLDHYANREITDHMDRLPRDIAQERLHHDIVQLLEEHNTVRNSQGPMGGHTMSPLLCPPNGFMGSVKQTPQGKKNRRANAKANGASLSRAEAKDAKGRGKKLSLDCHPGSGGLLESSVTLSPVDSLDSPRAYSANPGSPVMPVPGTFNLGSMSVPSTPLVNGLMEGPFAVSLARLNELGEIQGGGMMALQGRVPLQRAPSCVVNGLNLGMVNTNAMPFIWQTGVPTSHPHRNVMTGAPAASVPNLHQLHAQQVLMLQNQMAMQSPVKMAMDQQCQMVSMPPNPVHMRQQSMPHVAERSVQPLTPTEGSYFKQQSVPNDVTMQTSPAMSAPPQQTFAPSQEDTPKHYLHIPNEHPYLTPSPESPEQWSSPSPHSVSEWSDATPSPMVVGATHGQAPHLPEQGS

SEQ ID NO: 32 - protein, 2531 aa, Nomascus leucogenys
GPRCSQPGETCLNGGKCEAANGTEACVCGGAFVGPRCQDPNPCLSTPCKNAGTCHVLDRGGVADYACSCPLGFSGPLCLTPLDNACLTNPCRNGGTCDLLTLTEYKCRCPPGWSGKSCQQADPCASNPCANGGQCLPFEASYICHCPPSFHGPTCRQDVNECGQNPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGTYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGDMCNINIDECAGNPCHNGGTCEDGINGFTCRCPEGYHDPTCLSEVNECNSNPCVHGACRDSLNGYKCNCDPGWSGTNCDINNNECESNPCVNGGTCKDMTSGYVCTCREGFSGPNCQTNINECASNPCLNQGTCIDDVAGYKCNCLLPYTGEGALGPCSPGVTCNGGECRGSEDYESFSCVCPTGWQGQTCEVDINECVLSPCRHGASCQNTHGGYRCHCQAGYSGRNCETDIDDCRPNPCHNGGSCTDGINTAFCDCLPGFQGTFCEEDINECASDPCHNGANCTDCVDSYTCTCPAGFSGIHCENNTPDCTESSCFNGGTCMDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDTGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINLDDCNPLVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGRLRCLNGGTCISGPRSPTCLCLGPFTGPECQFPASSPCLGGNPCYNQGTCEPTSESPFYRCLCPAKFNGLLCHILDYSFGGGAGRDIPPPQIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELHKHPIKRAAEGWAAPDALLGQVKASLLPGGSGGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDPDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNKVSARLGCKGRGLNPQRSAGQTHGAQGHKGLTHRVLRVAGPACRPHLHGVGHLLNVLALLQPLFTEPFQVQVQLSGHGGSPHRPGPTLLGGTRTRVAAAPCGVGPLGVFAKAKDLEARRKKSQDSASPRPVTSGMLSPVDSLESPHGYLSDVASPPLLPSPFQQSPSVPLNHLPGMPDTHLGIGHLNVVAKPEMAALGGGGRLAFETGPPRLSHLPVASGTSTVLGSSSGGAMNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPPNIQQQQQSLQPPPPPPQPHLGVSSAASSHLGRSFLGGDPSQADVQPLGPSSLAVHTILPQESPALPTSLPSSLVPPVTAAQFLTPPSQHSYSSSPVDNTPSHQLQVPEHPFLTPSPESPDQWSSSSPHSNVSDWSEGVSSPPTSMQSQIARIPEAFK

SEQ ID NO: 33 - protein, 2057 aa, Canis lupus familiaris
GPAASLRRSWRRGGWPGTRPEPKVRGLSLLLLLAGPGAAAPPCLDGSPCMNGGRCTQLPSREAACLCPPGWVGERCQLEDPCHSGPCAGRGVCQSSVVAGAARFSCRCPRGFRGPDCSLPDPCLSSPCTPWARCSVGPMVATSAPAAPSPSGIGGHARQSGVLSYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDMDECQSSPCVNGGICKDRVNGFSCTCPSGFSGAMCQLDVDECASTPCRNGAKCVDQPDGYECRCAEGFEGTLCERNVDDCSPDPCHHGRCVDGIASFSCACAPGYTGTRCESQVDECRSQPCRHGGKCLDLVDKYLCRCPPGTTGVNCEVNIDDCASNPCTFGVCRDGINRYDCVCQPGFTGPLCNVEINECASSPCGDGGSCVDGENGFRCLCPPGSLPPLCLPPSHPCAQEPCSHGVCHDAPGGFRCVCEPGWSGPRCSQSLAPDACESQPCRSGGTCTSDGMGFHCTCPPGVQGRQCELPSPCVPNPCEHGGHCEASPGQLPVCSCSPGWQGPRCQQDVDECAGPSPCGSHGTCTNLEGSFSCTCHRGYSGPSCDQDIDDCDPNPCLNGGSCQDGVGSFSCSCLPGFAGPRCARDVDECLSSPCGPGTCTDHVASFTCTCPPGYGGFHCEQDLPDCSPSSCFHGGTCVDGVNSFSCQCRPGYTGAHCQHEADPCLSRPCLHGGVCTAAHPGYRCTCPEGFTGAQCQTLVDWCSRAPCQNGGRCARTGASFYCLCPPGWSGRLCDLRSVPCREAAAQTGVRLEELCQTGGQCVDKDNSHYCVCPEGRTGSHCEQEVDPCLAQPCQHGGTCQGYMGGYVCECPAGYTGDNCEDDVDECASQPCQHGGFCIDLVARYLCSCPPGTLGVLCEINEDDCGPGPPLDGGPRCLHNGTCVDLVGGFRCTCPPGYTGLRCEADINECRPGACHDAHTRDCLQDPGGGFRCICRTGFTGPRCQTVLSPCESQPCQHGGQCRPSPGPGGVLTFTCHCIPPFWGARCERVARSCRELQCPAGVPCQQTVRGPRCACAPGLSGPACRGARGSPPGAANASCVASPCLHGGSCRPAPLAPFFRCACAPGWAGPRCEAPAAAAPEAPEEPLCPSAACEAKSGDRRCDRECNSPGCGWDGGDCSLSVGDPWRQCAALQCWRLFNNSRCDPACSSPACLYDNFDCRAGGRERACNPVYEKYCADHFADGRCDQGCNTEECGWDGLDCAGEVPALLARGVLVVTVLLPPEELLRSSADFLQRLSSILRTSLRFRLDEHGQAMVFPYHRPGPGSESRNRRELAPEVIGSVVMLEIDNRLCLQSPENDHCFPDAQSAADYLGALSAVERLDFPYPLRAVRGEPLEPPEPSVPLLPLLAASAVFLLVILVLGVMVARRKREHSTLWFPEGFALHKDVAAGHKGRREPVGQDALGMKNMAKSESLMGDVATDWMDTECPEAKRLKVEEPSVGAEDAVDCRQWTQHHLVAADIRVAPAMALTPPQGDVDADGMDVNVRGPDGFTPLMLASFCGGALEPMPTEEDEAEDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPHGPHGLGPLLCPPGAFLPGLKVAQSGGKKSRRPPGKAGLGPQGARGRGKKLTLACPGPLAESSVTLSPDSLDSPRP

SEQ ID NO: 34 - protein, 2321 aa, Pan troglodytes
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCERNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCMDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQVGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 35 - protein, 2321 aa, Pongo abelii
MGPGARGRRRRRCPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCERNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQSWQGPRCQQDVDECAGPAPCGPHGICTNLAGSFSCTCHGGYTGPSCDQDINDCDPNPCLNGGSCQDGVGSFSCSCLAGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCPESFTGPQCQTLVDWCSRQPCQNGGRCVQTGAYCLCPPGWSGRLCDIRSLPCREAAAQIGVRLEQLCQAGGQCVDEDSSHYCVCLEGRTGSHCEQEVDPCLAQPCQHGGTCRGYMGGYMCECLPGYIGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCTCPPGLSGPSCRSFPGSPPGASNASCAAAPCLHGGSCRPAPLAPFYRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSESRARRELAPEVIGSVVMLEIDNRLCLQSPENDHCFPDAQSAADYLGALSAVERLDFPYPLRDVRGEPLEPPEPSVPLLPLLLAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDTKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPFPLSVPSSLAQAQTQLGPQPEVTPKRQVLA

SEQ ID NO: 36 - protein, 2289 aa, Cavia porcellus
AGGGGQGPREAQRWRSSPPSPGALPGLLLLLPLLAGLGAAGAPPCGLDGSPCANGGRCTQLPSREAACLCPPGWVGERCQLEDPCHSGPCAGRGVCQSSVVAGTARFSCRCPRGFRGPDCSLPDPCLSSPCAHGARCSVASDGRFVCSCPPGYQGRSCRSDVDECRVGRPCRHGGTCLNTPGSFHCQCPGGFAGPLCESPAVPCAPSPCRNGGTCRQSGELTYDCACLPGFEGQHCEVNVDDCPGHQCLNGGTCVDGVNTYNCQCPPEWTGQFCTEDVDECQLQPNACHNGGTCFNTLGSHSCVCVNGWTGESCSQNIDDCATAVCFHGATCHDRVASFYCACPMGKTGLLCHLDDACVSNPCHEDAICDTNPVNGRAICTCPAGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCERNVDDCSPDPCHHGRCVDGIASFTCACAPGYTGTRCESQVDECRSQPCRHGGKCLDLVDKYLCRCPPGTTGVNCEVNIDDCASNPCTFGVCRDGINRYDCVCRPGFIGPLCNVEINECASSPCGEGGSCLDVENGFRCLCPPGSLPPLCLPPSHPCAHEPCSHGVCHDAPGGFRCVCEPGWSGPRCSQSLARDTCESQPCRGGGTCVSDGTGFRCSCPPGVQGRQCELLSPCTPNPCEHGGRCEAAPGQPVVCSCPLGWQGPRCQQDVDECADPAACGPHGTCTNLAGSFSCTCHGGYTGPSCDKDIDDCNPNPCLNGGSCEDGVGSFSCSCLPGFAGPRCALDVDECASSPCGPGTCTDHVASFACSCPPGYGGLHCEKDLPDCSPRLLFHGGTCVDRVNSFSCLCRPGYTGVHCQYEADPCLSRPCLNGGVCSATHPGFRCACQEGFAGSQCQSLVDWCSQAPCKNGGRCVQTGAYCLCRPGWSGRLCDIRSLPCAEAAAQMGVRLEHLCQAGGQCVDKGGSYSCVCPEGRTGSHCEQEADPCMARPCQHGGTCRGYMGGYVCECPAGYSGDNCEDDVDECASQPCQHGGSCIDLVARYLCSCPPGTLGSHCEVNEDDCGPSPDLGLRCLHNGTCVDLVGGFRCNCPPGYTGLHCEADINECRPGACHAAHTQDCLQEPGGHFRCLCHAGFTGPRCQTALSPCESQPCQNAGQCRPSPGPGGVLTFTCHCVQPFWGPRCEHVARTCRELQCLPGVPCQQTPRGPRCACPPGVSGLSCRSKALPPGSTNASCAAAPCLHGGSCRPAPLAPFFRCGCAPGWTGPRCETSVAVSAPEVAEEPWCPRAACQAKRGNRRCDRECNIRACGWDGGDCSLSVDDPWRQCEALQCWRLFNNSRCDPACSSPACLYDNFDCHGRERTCNPVYEKYCADHFADGRCDQGCNTEECGWDGLDCASEVPALLARGVLVLTVLMPPEELLRSSADFLQRLSAILRTSLRFRLDANGKAMVFPYHRPSSGSEARTRRELAPEVIGSVVMLEIDNRLCLQSPENDHCFPDAQSAADYLGALSVVERLDFPYPLRDVRGEPLELPEPSVPMLPLLAAGAVFLLVILVLGVMVARRKREHSTLWFPEGFALHKDVAGGHKGRREPVGQDALGMKSMAKGETLMGEMASDWMDTDCPEAKRLKVEEPGVGAEEPVDCRQWTQHHLVAADIRVAPAMALTPPQGDADVEGVDVNVRGPDGFTPLMLASFCGGALESVPAEEEEAEDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHYANREITDHLDRLPRDVAQERLHQDIVRLLDQPSAFLPGLKTASSGPKKSRRPPGKKLTLACPGPLAESSVTLSPVDSLDSPRAFGGPPASPGSFPIEGSYAAAAATAVSLAQLGGPGRSGALGRTPRGCVLSLGLLNPVAVPLDWARLPPPAPPGPSFLLPLAAGPQLLNPGTPVSPQERPPPYLAAPGHGEEYPVAGTRGSPPKARFLRVPSEHPYLTPSPESPEHWASPSPPSLSDWSDSTPSPATAPGATATAAAALPSQPHPLSVQGSLAQAQSQLGAQPEGTPKRQVLA

SEQ ID NO: 37 - protein, 2270 aa, Macaca mulatta
MGPGARGRRRRRRPMSPPPPPPPVRALPLLLLLAGPGAAVPPCLDGSPCANGGRCTQLPSREAACLSVVAGTARFSCRCPRGFRGERGRVWRGGRRGCGQYQTNPVPFPPGPDCSLPDPCLSSPCAHSARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGGHWGQREWGGRPQVDMRQVAGLLRLFATGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGICKDRVNGFSCTCPSGFSGSTCQLDVDECASTPCRNGAKCVDQPDGYECRCAEGFEGMLCERNVDDCSPDPCHHGRCVDGIASFSCACAPGYTGTRCESQVDECRSQPCRHGGKCLDLVDKYLCRCPSGTTGVNCEVNIDDCASNPCSFGVCRDGINRYDCVCQPGFTGGQVAAMERGSLNRGHGICYDAPDTASSPWPTSLPGWSGPRCSQSLARDACESQPCRAGGTCSSDGMGFHCTCPPGVQGRQCELLSPCTPNPCEHGGLCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCPQSFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCEVRGRSPGEGREELGDRMGGCLHSFLTTPFLPPGVLCEINEDDCGPGPPLDSGPRCLHNGTCVDLVGGFRCTCPPGYTGLRCEADINECRSGACHAAHTRDCLQDPGGGFRCLCHAGFSGCGGRVSTFLNLDLFSSPSLPLTLLFASPPFLLLLPSTPLLHYFSSLPKPDPQPFWGPRCERVARACRELQCPVGVPCQQTPRGPRCACPPGLSGPSCRSFSGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVAAGHKGRREPVGQDALGMKNMAKGESLMGEVATDWMDTECPEAKRLKVEELGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGTHGLGPLLCPPGAFLPGLKATQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATATGALPAQPLPLSVPSSLAQAQTQLGPQPEVTPKRQVLA

SEQ ID NO: 38 - protein, 2318 aa, Felis catus
LLPAAKLPWGTAWPLSPPPHGGPCDPWALPLLLLLAGPGAAAPPCLDGSPCMNGGRCTQLPSREAACLCPPGWVGERCQLEDPCHSGPCAGRGVCQSSVVAGAARFSCRCPRGFRGPDCSLPDPCLSSPCAHGARCSGPDGRYLCSCPPGYQGRSCRSDVDECRVGGPCRHGGTCLNTPGSFRCQCPAGYTGPLCENAAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDVDECQSSPCVNGGVCKDRVNGFSCTCPSGFSGAMCQLDVDECASTPCRNGAKCVDQPDGYECRCAEGFEGTLCERNVDDCSPDPCHHGRCVDGIASFSCACAPGYTGTRCESQVDECRSQPCRHGGKCLDLVDKYLCRCPPGTTGVNCEVNIDDCASNPCTFGVCRDGINRYDCVCQPGFTGPLCNVEINECASSPCGDGGSCVDGENGFRCLCPPGSLPPLCLPTSHPCAQEPCSHGVCHDAPGGFRCMCEPGWSGPRCSQSLARDACESQPCRSGGTCTSDGIGFHCTCPPGVQGRQCELPSPCTPNPCEHGGHCESAPGQLPVCSCPPGWQGPRCQQDVDECAGPSPCGSHGTCTNLAGSFSCTCHEGYSGPSCDQDIDDCDPNPCLNGGSCQDGVGSFSCSCLPGFAGPRCARDVDECLSSPCGPGTCADHVASFTCTCPPGYGGFRCEQDLPDCSPSSCFHGGTCVDGVNSFSCQCRPGFTGAHCQHEADPCVSRPCLHGGVCTAARPGFRCTCPEGFTGAQCQTLVDWCSHAPCQNGGRCARSGASFYCLCPPGWSGRVCDIRSVPCREAAAQIGVRLEELCQTGGQCVDKDNSHYCVCPEGRTGSHCEQEVDPCLAQPCQHGGTCRGYMGGYVCECPAGYTGDDCEDDVDECASQPCQNGGFCIDLVARYLCSCPPGTLGVLCEINEDDCGPGPPLDQGPRCLHNGTCVDLVGGFRCTCPPGYTGLRCEADINECHPGACHDAHTRDCLQDPGGGFRCLCHGGFTGPRCQTVLSPCESQPCQHGGQCRPSPGPGGALTFTCRCVPPFWGPRCERVARTCAGVPCQQTVRGPRCACPPGLSGPACRGSRGSPPGAANASCLASPCLHGGSCGPAPLAPFFRCACAPGWDGPRCEVPAAAPEAPEEPLCPSAACEAKSGDKRCDRECNSPGCGWDGGDCSLSVGDPWRQCAALQCWRLFNNSRCDPACSSPACLYDNFDCRAGGRERACNPVYEKYCADHFADGRCDQGCNTEECGWDGLDCAGEVPALLARGVLVLTVLLPPEELLRSSADFLQRLSGILRTSLRFRLDEHGQAMVFPYHRPGPGAESRNRRELAPEVIGSVVMLEIDNRLCLQSPENDHCFPDAQSAADYLGALSAVERLDFPYPLRAVRGEPLELPEPSMPLLPLLAASAVFLLAILVLGVMVARRKREHSTLWFPEGFALHKDVAAGHKGRREPVGQDALGMKNMAKSESLMGQVATDWMDTECPEAKRLKVEDPGVGAEDAVDCRQWTQHHLVAADIRVAPAMALTPPQGDVDADGVDVNVRGPDGFTPLMLASFCGGALEPMPTEEDEAEDASASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKVAQSGGKKSRRPPGKAGLGPQGARGRGKKLTLACPGPLAESSVTLSPVDSLDSPRPFGGPPASPGGFSLEGPYAAATATAVSLAQLGGAGRAGLGRQPPGGCVLSLGLLNPVAVPLDWARLPPPAPPGPSFLLPLAPGPQLLNPGTPVSPQERPPPYLVAPGHGEEYPAAGAHGSPPKARFLRVPSEHPYLTPSPESPEHWASPSPPSLSDWSDSTPSPATATGPAATAAGALPAQPLPLSVPGPLAQAQTQLGPQPEVTPKRQVLA

SEQ ID NO: 39 - protein, 2309 aa, Papio anubis
EGPRVPDRVRRSWRRGGWPGTRPEPSVRALPLLLLLAGPGAAAPPCLDGSPCANGGRCTQLPSREAACLCPPGWVGEWCQLEDPCHSGPCAGRGVCQSSVVAGTARFSCRCPRGFRGPDCSLPDPCLSSPCAHSARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGMLCERNVDDCSPDPCHHGRCVDGIASFSCACAPGYTGTRCESQVDECRSQPCRHGGKCLDLVDKYLCRCPSGTTGVNCEVNIDDCASNPCSFGVCRDGINRYDCVCQPGFTGPLCNVEINECASSPCGEGGSCVDGENGFRCLCPPGSLPPLCLPPSHPCAHESCSHGICYDAPGGFRCVCEPGWSGPRCSQSLARDACESQPCRAGGTCSSDGMGFHCTCPPGVQGRQCELLSPCTPNPCEHGGRCESTPGQLPVCSCPQGWQGPRCQQDVDECAGPAPCGPHGICTNLAGSFSCTCHGGYTGPSCDQDINDCDPNPCLNGGSCQDGVGSFSCSCLHGFAGPRCARDVDECLSNPCGPGTCTDHVASFTCTCPPGYGGFHCEQDLPDCSPSSCFNGGTCVDGVNSFSCLCSPGYTGAHCQHEADPCLSRPCLHGGVCSAAHPGFRCTCPQSFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGRCRGYMGGYMCECLPGYNGENCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQVGVGGGLWRRGRGVGSGVPPPTFPGGLKGKGGEGAWPPGVAGRVCQVGSPLWKGERLASPNLTPNRSGGPRCERMARFCREFRCACAQGWTGPRCEAPAVAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPNPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVATGHKGRREPVGQDALGMKNMAKGESLMGEVATDWMDTECPEAKRLKVEELGMGAEEAVDCRQWTQHHLVAADIRVAPAMALTPPQGDADADGMDVNVRGPDGFTPLMLASFCGGTLEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGTHGLGPLLCPPGAFLPGLKATQSGSKKSRKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATATGALPAQPLPLSVPSSLAQAQTQLGPQPEVTPKRQVLA

SEQ ID NO: 40 - protein, 2471 aa, Canis lupus familiaris
MPGLSPARLWALLALGLSCAAPARALQCRDSYEPCVNEGVCVTYHNGTGYCKCPEGFLGEYCQHRDPCERNRCQNGGTCVAQAMLGKATCRCALGFTGDDCQYSTTHPCFVSHPCLNGGTCHMHSRDDYECTCQVGFTGKLCQWTDACLSHPCANGSTCTTVANQFSCKCLTGFTGQKCEIDVNECDIPGQCQHGGTCLNLPGSYQCQCPQGFTGKHCDSPYVPCAPSPCVNGGTCRQTGDFTFECNCLPGFEGITCERNIDDCPNHKCQNGGVCVDGVNTYNCRCPPQWTGQFCTEDVDECLLQPNACQNGGTCTNRNGGYGCVCVNGWSGDDCSENIDDCAFASCTPGSTCIDRVASFSCMCPEGKAGLLCHLDDACISNPCHKGALCDTNPLNGQYICTCPQGFKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCVHGVCMDGINRYSCVCSPGFTGQRCNIDIDECASNPCRKGATCINDVNGFRCLCPEGPHRPSCYSQVNECLSSPCIHGNCTGGPSGYKCLCDAGWIGINCEVDKNECLSNPCQNGGTCDNLVNGYRCTCKKGFKGYNCQVNIDECASNPCLNQGTCFDNISGYTCHCVLPYTGKNCQTVLAPCSPNPCENAAVCKEAPDFESYTCLCAPGWQGQRCTIDIDECVSKPCMNHGLCHNTQGSYMCECPPGFSGMDCEDDIDDCLANPCQNGGSCVDGVNTFSCLCHPGFIGDKCQTDMNECLSEPCKNGGTCSDYVNSYTCKCQAGFDGVHCENNIDECTESSCFNGGTCVDGINSFSCLCPLGFTGPFCLHEINECNSHPCLNEGICVDGLGTYRCTCPLGYTGKNCQTLVNLCSRSPCKNKGTCIQEKAESRCLCPSGWAGAYCDVPNVSCEVAALHRGVSTDHLCQHSGICINAGNSHHCQCPLGYTGSYCEEQLDECSSNPCQHGATCRDFIGGYRCECVPGYQGVNCEYEVDECQNQPCQNGGTCVDLVNHFKCSCPPGTRGLLCEENIDDCVGGPHCLNGGQCVDRIGGYSCRCLPGFAGERCEGDINECLSNPCSSEGSLDCIQLTNDYLCVCRSAFTGRHCETFIDVCPQMPCLNGGTCAVASNMPDGFICRCPPGFSGAKCQSSCGQVKCRRGEQCVHTASGPRCFCPNPQDCESGCASSPCQHGGSCYPQRQPPYYSCQCSPPFWGSHCELYMAPTSTPPATCLSQYCADKARDGVCDEACNSHACQWDGGDCSLTMENPWANCSSPLPCWDYINNQCDELCNTAECLFDNFECQGNSKTCKYDKYCADHFKDNHCDQGCNSEECGWDGLDCAADRPENLAEGTLVIVVLMPPEQLLQDARSFLRALGTLLHTNLHIKRDSQGALMVYPYYGEKSAATKKQRMTRRSLPGDQEQEVAGSKVFLEIDNRQCVQDSDQCFKNTDAAAALLASHAIQGTLSYPLVSVVSESLNPKPTQLLYLLAVAVVIILFIILLGVIMAKRKRKHGSLWLPEGFTLRRDSSNHKRREPVGQDAVGLKNLSVQVSEANLIGSGTSEHWVDDEGPQPKKAKAEDEALLSEEDDAIDRRPWTQQHLEAADIRRTPSLALTPPQAEQEVDVLDVNVRGPDGCTPLMLASLRGGSSDMSDEDEDGEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKPRRPNTKSTMPTSLPNLAKEAKDAKGSRRKKSLSDKGQLSESSVTLSPVDSLESPHTYVSDTTSSPMITSPGILQASPNPMLATAAPPAPAHAQHALSFSNLHEMQPLAHGASTVLPSVSQLLSHHHIAPPGNGSAGSLGRLHPVTVSADWMNRMEMNETQYNEMFGMVLAPAESTHPGIPPQSRPPEGKHITTPREPLPPIVTFQLIPKGSIAQPAGTPQPQSNCPPPVAGPMPTMYQIPEMARLPSMAFPTAMVPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPRSNMQVYA

SEQ ID NO: 41 - protein, 2471 aa, Ovis aries
MPALRPAPLWALLALWLCRAAPARALQCRDGYEPCVNEGICVTYHNGTGYCKCPEGFLGEYCQHRDPCEKNRCQNGGTCVAQAMLGKATCRCALGFTGEDCQHSTTHPCFVSQPCLNGGTCHVLSRDTYECTCQVGFTGKLCQWTDACLSHPCANGSTCTTVANQFSCTCLAGFTGQKCEADVNECDIPGQCQHGGTCLNLPGSYQCQCPQGFTGQHCDSPYVPCAPSPCVNGGTCRQAGDFTFECSCLPGFEGVTCERNIDDCPNHKCQNGGVCVDGVNTYNCRCPPQWTGQFCTEDVDECLLQPNACQNGGTCTNRNGGYGCVCVNGWSGDDCSENIDDCAFASCTPGSTCIDRVASFSCMCPEGKAGLLCHLDDACISNPCHKGALCDTNPLNGQYICTCPQGYKGSDCTEDVDECAMANSNPCEHAGKCVNTDGAFHCECLKGYAGPRCEMDINECHSDPCKNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNEGRCIDLVNGYQCNCQPGTSGVNCEINFDDCASNPCVHGVCMDGVNRYSCVCSPGFTGQRCNIDIDECASNPCRKGATCINDVNGFRCICPEGPHHPSCYSQVNECLSNPCVHGNCTGGLTGYKCLCDAGWVGINCEVDKNECLSNPCQNGGTCDNLVNGYRCTCKKGFKGYNCQVNIDECASNPCLNQGTCFDDVSGYTCHCVLPYTGKNCQTVLAPCSPNPCENAGVCKEAPNFESYSCLCAPGWQGQRCTIDIDECVSKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNIDECTESSCFNGGTCIDGINSFSCLCPVGFTGSFCLHEINECNSHPCLNEGVCVDGLGTYRCICPLGYTGKNCQTLVNLCSRSPCKNKGTCIQDKAESRCLCPSGWAGAYCDVPSVSCEVAASRRGVPVDRLCQHSGVCISAGNSHHCQCPLGYTGSYCEDQLDECSSNPCQHGATCRDFIGGYRCECVPGYQGVNCEYEVDECQNQPCQNGGTCIDLVNHFKCSCPPGTRGLLCEENIDDCARGPHCLNGGQCVDRIGGYSCRCLPGFAGERCEGDINECLSSPCSSEGSLDCIQLTNDYLCVCRSTFTGRHCETFVDVCPQMPCLNGGTCAVASNMPDGFICRCPPGFSGVRCQSSCGQVKCRRGEQCVHTASGPRCFCPNPQDCDSGCASSPCQHGGSCHPQRQPPYYSCQCAPPFRGSHCELYSTPTSTPPATCLSQYCADKARDGICDDVCNSHACQWDGGDCSLTMEDPWANCSSPLPCWEYINNQCDELCNTAECLFDNFECQKSSKTCKYDKYCADHYEDNHCDQGCNSEECGWDGLDCAADRPENLAEGTLVIVVLMPPEQLLQDARRFLRALGTLLHTNLRIKRDAQGELMVYPYYGGKSAAMKKQRLTRRSLPGDEEQEVAGSQVFLEIDNRQCVQDSDQCFKNTDAAAALLASHAIQGTLSYPLVSVVSESLAPKRTPLLYLLAVAVVIILFIILLGVIMAKRKRKHGSLWLPEGFTLRRDSSNHKRREPVGQDAVGLKNLSVQVSEANLIGSGTSEHWVDDEGPQPKKAKAEDEALLSEEDDPIDRRPWTQQHLEAADIRRTPSMALTPPQAEQEVDVLDVNVRGPDGCTPLMLASLRGGSSDMSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPNTKSAVPTSLPNLAKEAKDAKGNRRKKSLSDKGQLSESSVTLSPVDSLESPHTYVSDTTSSPMITSPGILQASPTPMLATAAPTGPVHAQHALSFSNLHEMQPLAHGANTVLPSVSQLLSHHHIVPPGSSTAGSVGRLHPVPVPADWMNRVEVNESQYNEMFGMVLAPAEGTHPGIAPQSRPPEGKHLTTPREPLPPIVTFQLIPKGSIAQPTGAAQPPSNCPPAVAGTLPTMYQIPEMARLPSMAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPRSNMQVYA

SEQ ID NO: 42 - protein, 2471 aa, Felis catus
MPALLPAPLWALLALWLCRAAPARALQCRDSYEPCVNEGICVTYHNGTGYCKCLEGFLGEYCQHRDPCEKNRCQNGGTCVAQAMLGKATCRCALGFTGDDCQYSTAHPCFVSHPCLNGGTCHVRSRDDYECTCQVGFTGKLCQWTDACLSHPCANGSTCTTVANQFSCRCLAGFTGQKCETDVNECDIPGQCQHGGTCLNLLGSYQCQCPQGFTGQHCDSPYVPCAPSPCVNGGTCRQTGDFTFECNCLPGFEGITCERNIDDCPNHKCQNGGVCVDGVNTYNCRCPPQWTGQFCTEDVDECLLQPNACQNGGTCTNRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLRGYTGPRCELDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCVHGVCMDGINRYSCVCSPGFTGQRCNIDIDECASNPCRKGATCINDVNGFRCLCPEGPHHPSCYSQVNECLSSPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKEAPNFESYTCLCAPGWQGQRCTIDIDECVSKPCMNHGLCHNTQGSYMCECPPGFSGMDCEEDIDDCLARPCHDSSSKCRWSDTFSCLCHPGFIGDKCQTDMNECLSEPCKNGGTCSDYVNSYTCKCQAGFDGVHCENNIDECTESSCFNGGTCVDGINSFSCLCPVGFTGPFCLHEINECNSHPCLNEGVCVDGLGTYRCTCPLGYTGKNCQTLVNLCSRSPCKNKGTCVQEKAESRCLCPSGWAGAYCDVPNVSCEVAAFHRGVSIDHLCQHSGICINAGNSHHCQCPLGYTGSYCEEQLDECSSNPCQHGATCRDFIGGYRCECVPGYQGVNCEYEVDECQNQPCQNGGTCVDLVNHFKCSCPPGTRGLLCEENIDDCAGGPHCLNGGQCVDRIGGYSCRCLPGFAGERCEGDINECLSNPCSSEGSLDCIQLTNDYLCVCRSAFTGRHCETFVDVCPHMPCLNGGTCAVASNMPDGFICRCPPGFSGARCQSSCGQVKCRRGEQCVHTASGPRCFCPNPQDCESGCASSPCQHGGSCYPQRQPPYYFCQCSPPFWGSHCELYTAPTSTPPATCLSQYCADKARDGVCDEACNSHACQWDGGDCSLTMENPWANCSSPLPCWDYINNQCDELCNTAECLFDNFECQGNSKTCKYDKYCADHFKDNHCDQGCNSEECGWDGLDCAADRPENLAEGTLVIVVLMPPEQLLQDARSFLRALGTLLRTNLQIKRDSQGVLMVYPYYGEKSAAMKKQRMIRRSLPGDQEQEVVGSKVFLEIDNRQCVQDSDQCFKNTDAAAALLASHAIQGTLSYPLVSVVSESLTRKGTQLLYLLAVAVVIILFIILLGVIMAKRKRKHGSLWLPEGFTLRRDSSNHKRREPVGQDAVGLKNLSVQVSEANLIGSGTSEHWVDDEGPQPKKAKAEDEALLSEEDDAIDRRPWTQQHLEAADIRRTPSLALTPPQAEQEVDVLDVNVRGPDGCTPLMLASLRGGSSDMSDEDEDGEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKPRRPNTKSAMPTSLPNLAKEAKDAKGSRRKKSLSDKGQLSESSVTLSPVDSLESPHTYVSDTTSSPMITSPGILQASPNPMLATAAPPAPVHAQHALSFSNLHEMQPLAHGANTVLPSVSQLLSHHHIVPPGSGSTGSLGRLHPVTVPADWMNRMEMNETQYNEMFSMVLAPAEGTHPGIAPQSRPPEGKHITTPREPLPPIVTFQLIPKGSISQPAGTPQPQSNCPPPVAGPVPTMYQIPEMARLPNMAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPRSNMQVYA

SEQ ID NO: 43 - protein, 2471 aa, Chlorocebus sabaeus
MPALRPALLWALLALWLCRAAPARALQCRDGYEPCVNEGMCVTYHNGTGYCKCPEGFLGEYCQHRDPCEKNRCQNGGTCVAQAMLGKATCRCASGFTGEDCQYSTSHPCFMSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQHCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECVSKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNIDECTESSCFNGGTCVDGINSFSCLCPVGFTGLFCLHEINECSSHPCLNEGTCVDGLGTYHCSCPLGYTGKNCQTLVNLCSRSPCKNKGTCIQDKAESRCRCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCVDRIGGYSCRCLPGFAGERCEGDINECLSNPCSSEGSLDCIQLTNDYLCVCRSTFTGRHCETFVDVCPQMPCLNGGTCAVASNMPDGFICRCPPGFSGARCQSSCGQVKCRKGEQCVHTASGPRCFCPNPRDCESGCASSPCQHGGSCHPQRQPPYYSCQCAPPFWGSRCELYTAPPSTPPATCLSQYCADKARDGVCDEACNSHACQWDGGDCSLTMENPWANCSSPLPCWDYINNQCDELCNTAECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSIPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGSGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPASVHAQHALSFSNLHEMQPLAHGASTVLPSVSQLLSHHHIVPPGSGSAGSLSRLHPVPVPADWMNRMEVNETQYNEMFGMVLAPAEGTHPSIAPQSRPPEGKHITTPREPLPPIVTFQLIPKGSIAQPAGAPQPQSTCPPAVTGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 44 - protein, 2443 aa, Gorilla gorilla gorilla
MPALRPALLWALLALWLCCAVPAHCPEGLLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGICRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGSGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQVPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 45 - protein, 2471 aa, Sus scrofa
MPALRPAPLWALLALLLCRAAPARALQCRDNYEPCVNEGICIAYHNGTGYCKCPEGFLGEYCQHRDPCEKNRCQHGGTCVAQAMLGKATCRCAMGFTGENCQYSTTHPCFMSHPCQNGGTCHVLSRDAYKCTCQVGFTGKLCQWTDACLSHPCANGSTCTTVANQFSCTCLAGFTGQKCETDVNECDVPGQCQNGGTCLNLPGSYQCQCPQGFTGQHCDSPYVPCAPSPCVNGGTCRQTGDFTFECNCLPGFEGITCERNIDDCPNHKCQNGGVCVDGVNTYNCRCPPQWTGQFCTEDVDECLLQPNACQNGGTCTNRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNSGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNEGRCIDLVNGYQCNCQPGTSGVNCEINFDDCASNPCVHGVCVDGVNRYSCVCSPGFTGQRCNIDIDECASNPCRKGATCINDVNGFRCMCPEGPHHPSCYSQVNECLSNPCIHGNCTGGLSGYKCLCDAGWVGINCEVDKNECLSDPCQNGGTCDNLVNGYRCTCKKGFKGHNCQVNIDECASNPCLNQGTCFDDISGYTCHCVLPYTGKNCQTVLAPCSPNPCENAAVCKEAPNFESYTCLCAPGWQGQRCSVDIDECISKPCMNHGLCHNTQGSYMCECPPGFSGMDCEEDIDDCLANPCQNGGSCIDGVNTFSCLCLPGFIGDKCQTDMNECLSEPCKNGGTCSDYVNSYTCKCQAGFDGVHCENNIDECTESSCFNGGTCVDGLNSFSCLCPVGFTGPFCLHEINECNSHPCLNEGICVDGLGTYRCICPLGYTGKNCQTLVNLCSRSPCKNKGTCVQEKAESRCLCPSGWAGAYCDVPSVSCEVAASHRGVPVDRLCQHSGVCINAGNSHHCQCPLGYTGSYCEEQLDECSSNPCQHGATCRDFIGGYRCECVPGYQGVNCEYEVDECQNQPCQNGGTCIDLVNHFKCSCPPGTRGLLCEENIDDCARGPHCLNGGQCVDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCKKGEQCVHTASGPRCFCPNPQDCESGCASSPCQHGGSCYPQRQPPYYSCQCSPPFWGSHCELYTAPPSAPPATCLSQYCADKARDGVCDEACNSHACQWDGGDCSLTMENPWANCTSPLPCWDYINNQCDELCNTAECLFDNFECQGNSKTCKYDKYCADHFRDNHCDQGCNSEECGWDGLDCAGDRPENLAEGTLVIVVLMPPEQLLQDARSFLRALGTLLHTNLRIKRDSQGDLMVYPYYGEKSAAMKKQKMTRRSLPGDQEQEVAGSQVFLEIDNRQCVQDSDQCFKNTDAAAALLASHAIQGTLSYPLVSVVSESLTPKRTQLLYLLAVAVVIILFIILLGVIMAKRKRKHGSLWLPEGFTLRRDSSNHKRREPVGQDAVGLKNLSVQVSEANLIGSGTSEHWVDDEGPQPKKAKAEDEALLSEEDDPIDRRPWTQQHLEAADIRRTPSLALTPPQAEQEVDVLDVNVRGPDGCTPLMLASLRGGSSDMSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPNAKNAVPTSLPNLAKEGKDAKGNRRKKSLSDKGQLSESSVTLSPVDSLESPHTYVSDTTSSPMITSPGILQASPNPMLAPAAPPAPVHAQHALSFSNLHEMQPLAHGTSTVLPSVSQLLSHHHIVPPGSSSAGSLGRLHPVTVPADWMNRVEVNETQYNEMFSMVLAPAEGTHPGITPQSRPPEGKHLTTSREPLPPIVTFQLIPKGSIAQPAGAAQPPSNCPPAVAGNLPTMYQIPEMARLPSMAFPTGMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPRGNMQVYA

SEQ ID NO: 46 - protein, 2362 aa, Oryctolagus cuniculus
MGGLPTPTGTPPAHCSCCLVEGWRGSAAGCRGGVLGTLLTPTSPPFLRLSPPAAPPCLDGSPCANGGRCTQLPSREAACLCPPGWVGERCQLEDPCHSGPCAGRGVCQSSVVAGVARFSCRCPRGFRGPDCSLPDPCLSSPCAHGARCSVGSDGRFVCSCPPGYQGRSCRSDVDECRVGGPCRHGGTCLNTPGSFRCQCPGGYTGLLCEIPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTFCEVDIDECQSSPCVNGGVCRDRVNGFSCTCPSGFSGATCQLDVDECASTPCRNGAKCVDQPDGYECHCAEGFEGTLCERNVDDCSPDPCHHGRCVDGIASFSCACAPGYTGTRCESQVDECRSQPCRHGGKCLDLVDKYLCRCPPGTTGLNCEVNIDDCASNPCTFGVCRDGINRYDCVCQPGFTGPLCNVEINECASNPCGEGGSCVDGENGFRCLCPPGSLPPLCLPPTHPCAHEPCSHGICHDAPGGFRCVCEPGWSGPRCSQSLNRDACESQPCRAGGTCTSDGSGFRCTCPPGVQGVSVSLFPPQAPTALSSSPLDTGLCFAFSLSPQELGGWTTSFHLPHTGRQCELLSPCTPNPCEHGGHCESGPGQMPVCSCSAGWQGTRPRCQQDVDECAGGPSPCGPHGTCTNLMGSFSCTCHGGYTGPSCDQDINDCDPNPCLNGGSCQDGTGSFSCSCLPGFTGPHCARDVDECLSSPCGPGTCTDHVASFTCTCPPGYGGLHCEKDLPDCSPSSCFNGGTCVDGVNSFSCLCRPGYTGAHCQHEADPCLSRPCLHGGVCSAAHPSFRCTCPEGFTGSQCQTPVDWCSHGLCQNEGRCVQTGAYCLCPPGWSGRFCDVRSLPCKEAAAQMGVPLDQLCQGGGQCVSEDNSHFCLCPEGRTGSHCEQEVDPCGAQPCQHGATCRGYMGGYVCECPAGYTGDKCQDDVDECASQPCQHGGSCIDLVARYLCSCPPGTLGVLCEIDEDDCGPGPPSDAAGPRCLHNGTCVDLVGGFRCSCPPGYTGLHCEADINECRPGACHAAHTRDCLQDPGGHFHCLCHPGFTGPRCQTVLSPCESQPCQHGGQCRPGPGPGGGLSFTCHCLQVGGAYPENGAGGGPPRPGLDPTSLSFSPHPPSISLSPVPDCPPCLNRGALYRAPPPLAPFFFPGAVPPLGWDRAPASREPRCRAPPSQAKRGDQRCDRECNSPGCGWDGGDCSLSVGDPWRQCEALQCWRLFNNSRCDPACSSPACLYDNFDCHAGGRERTCKYEKYCADHFADGRCDQGCNTEECGWDGLDCAREVPALLARGVLVLTVLLPPEELLRSGADFLQRLSAILRTSLRFRLDARGQAMIFPYHRPGSVASEARARRELAPEVIGSVVMLEIDNRLCLQSPENDHCFPDAQSAADYLGALSAVERLDFPYPLRDVRGEPLEPPEPSLPLLPLLAAGAVFLLLILVLGVMVARRKREHSTLWFPEGFALHKDVAGGHKGRREPVGQDALGMKNMAKGESLMGEVATDWMDTECPEAKRLKVEEPGMGAEEAVDCRQWTQHHLVAADIRVAPAMALTPPQGDADTDGMDVNVRGPDGFTPLMLASFCGGALEPMPTEEDEAEDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKATQSGAKKSRRPPGKAGLGAQGARGRGKKLTLACPGPLAESSVTLSPVDSLDSPRPFGGPPASPGAFPLEGPYAAAAATAVSLAQLGGAGRAGPLGRQPPGGCVLSLGLLNPVAVPLDWARLPPPAPPGPSFLLPLAPGPQLLNPGTPVSPQERPPPYLAAPGHGEEYPAPGAHGSPPKARFLRVPSEHPYLTPSPESPEQWASPSPPSLSDWSESTPSPATAAGATATATAAGALPAQPHPLSVPGSLAQAQTQLGPQPEVTPKRQVLA

SEQ ID NO: 47 - protein, 2447 aa, Cavia porcellus
ALQCRDDYEPCVNEGICVTYHNGTGYCKCPEGFLGEYCQHRDPCEKNRCQNGGTCVAQAMLGRATCRCALGFTGEDCQYSTSHPCFVNPPCQNGGTCHMLSWDTYECTCQVGFTGKLCQWIDACLSQPCANGSTCTTVANQFSCKCLAGFTGQKCETDVNECDIPGQCQNGGTCLNLPGSYQCQCSQGFTGQHCDNPYVPCAPSPCVNGGTCRQTGDFTFECSCLPGFEGSTCERNIDDCPNHRCQNGGVCVDGVNTYNCRCPPQWTGQFCTEDVDECLLQPNACQNGGTCTNRNGGYGCVCVNGWSGDDCSENIDDCAFASCTPGSTCIDRVASFSCMCPEGKAGLLCHLDDACISNPCHKGALCDTNPLNGHYICTCPQGYKGADCTEDVDECAMTNSNPCEHAGKCVNTDGAFHCECLKGYAGPRCEMDINECHSDPCQNDATCLDKIGGFTCLCMPGFKGVHCEIEINECQSNPCVNNGQCVDKVNRFQCLCPPGFTGPVCQIDIDDCSSTPCLNGAKCIDHPNGYECQCATGFTGLLCEENIDNCDPDPCHHGQCQDGIDSYTCICNPGYMGAICSDQIDECYSSPCLNEGRCIDLVNGYQCNCQPGTSGVNCEINFDDCASSPCVNGTCVDGISRYSCVCSPGFTGQRCNVDIDECASNPCRKGATCINDVNGFRCICPEGPHHPSCYSQVNECLSNPCIHGSCIGGLSGYKCLCDAGWVGINCEVDKNECLSNPCQNGGTCDNLVNGYKCTCKKGFKGYNCQVNIDECASNPCLNQGTCFDDVSGYTCQCALPYTGKNCQTVLAPCSPNPCENAAVCKEAPNFESFTCLCAPGWQGQRCTVDIDECVSKPCMNHGLCHNTQGSYMCECPPGFSGMDCEEDINDCLANPCQNGGSCVDGVNTFSCMCLPGFIGDKCQTDMNECLSEPCKNGGTCSDYVNSYTCKCQAGFDGVHCENNIDECTDSSCFNGGTCVDGINSFSCLCPVGFTGPFCLHEINECSSHPCLNEGTCVDGLGTYRCTCPLGYTGKNCQTLVNLCSQSPCKNKGTCIQEKAESRCLCPSGWTGAYCDVPNVSCDVAALNKGVLAKNLCKNSGACINAGNTHHCQCPLGYTGSYCEQQLDECASNPCKHGATCTDFIGGYRCECVPGYQGVNCEYEVDECQNQPCRNGGTCVDLVNHFKCSCPPGTRGLFCEENIDDCAGGPHCLNGGQCVDRIGGYSCRCLPGFAGERCEGDINECLSNPCNSEGSLDCIQLTNNYQCVCRSTFTGRHCETFVDVCPQKPCLNGGTCAVASNMPDGFICRCPPGFSGAKCQSSCGQVKCRKGEQCVHTAAGPRCFCPSPQDCESGCASSPCQHGGSCYPQRQPPYYSCHCSVPFGGNHCQFYMAPTSIPSDICASQYCADKARDGVCDEVCNSHACQWDGGDCSLTMEDPWANCSSPLPCWNYINNQCDELCNTAECLFDNFECQGNSKTCKYDKYCADHFKDNHCDQGCNSEECGWDGLDCAADQPENLAEGTLVIVVLMPPEQLLQDARSFLRALGTLLHTNLRIKLDSQGLPMVYPYYGEKSAAMKKQKLSRRSLPDEQEQEVAGSQVFLEIDNRQCVQDSEQCFKNTDAAAALLASHAIQGTLSYPLVSVVSESLSPKPTPLLYLLAVAVVFILFIILLGVIMAKRKRKHGSLWLPEGFTLRRDSSNHKRREPVGQDAVGLKNLSVQVSEANLIGSGTSEHWVDDEGPQPKKAKAEDEALLSEEEDPIDRRPWTQQHLEAADIRRTPSLALTPPQAEQEVDVLDVNVRGPDGCTPLMLASLRGGSSDMSDEDEDGEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMAKKSRRPNAKSTMPTSLPNLAKEAKDAKGSRRKKSLSEKVQLSESSVTLSPVDSLESPHTYVSDTTSSPMITSPGILQASPNPMLAAAAPQAPVHAQHALSFPNPHEMQPLAPGASTVLPSVSQLLSHHHIVPPGSSSAGNLSRLHPVTVPADWMNRMEMSDTQYNEMFGMVLTPAEGTHPGIAPQSRPPEGKHVPTPRETLPPIVTFQLIPKGSIAQPAGASQPQSTCPPAVAGPLPTMYQIPEMARLPGVAFPTAMMPQQDGQVAQTILPAYHPFPASVGKYPTPPSQHSYASSNAAERTPNHSGHLQGEHPYLTPSPDSPDQWSSSSPHSASDWSDVTTSPTPGSGGGGQRGPGTHMSEPPHSNMQVYA

SEQ ID NO: 48 - protein, 2368 aa, Xenopus tropicalis
  misc_feature (425)..(425): Xaa can be any naturally occurring amino acid
FCKICTDAFVGKYCQLQNPCQETICLNGGTCKVSSDLSKGVCTCAPGFGGENCKQPVANVCSLTQPCMNGGTCRLLTLELYDCICPFGWRGNDCKFIDACASQPCANGSTCIPNENQYTCSCQAGYTGLKCEVDVNECGPPGMCKNGGTCENLPGSYRCQCHPGYTGQRCESPFIPCSPSPCMNGGTCRQTSEFAYECNCLPGFDGKNCETNIDDCPSHKCQNGGTCVDGVNTYNCRCPPQWTGQFCTEDVDECQLQPNACQNGGTCTNSNGGYNCVCVNGWSGDDCSQNIDDCATAACANGSTCIDRVASFICVCPEGKIGLLCHKNDACFSNPCHMGSLCDTNPLTGQAICTCPSGYKGTACTEDIDECSLVNSNPCEHAGKCVNTEGSFYCECSKGFTGPRCEMDINECLSEPCQNDATCLXFTCLCMPGYKGIHCEIEINECLSNPCVNNGECVDKVNRFVCICPPGFTGSVCQIDIDDCSSTPCQNGAKCVDHPSGYDCICATGFTGVLCEENINNCEPPPCHYGTCQDGIDSYTCICEPGYMGAICSDQIDECLSNPCLNEGRCVDLVNGYQCNCLPGTSGPRCEKNVDDCASNPCTYGNCVDGINRYDCVCSPGFTGPQCKDDIDECASNPCHNGGTCVNEQNRFRCICPEGFRQPSCFSQVDECVNNPCIHGNCTDDVNGYKCLCQPGWTGKKCEVDKNECLSNPCQNGGTCDNLVNGYRCSCKKGFKGYNCQIDIDECASNPCLNHGTCRDGINGYTCHCGLPYTGTNCQNILTPCSPEPCHNGGICQESEDFKSFSCLCATGWHGQRCTIDIDECITNPCKNYGRCQNTKGGYICHCFEGFNGVNCENNIDDCLSNPCQNGASCVDGINTFSCNCLAGFHGDKCQKDVDECASNPCKNGGSCTDYVNSYTCKCQPGFDGIHCDNNIDECTDTSCFNGATCVDGINSFTCQCPQGFTGQFCLFEINECGSHPCINGGTCVDGMGTYHCTCPVGYRGKNCEELVDLCSGFPCKNRGICKQVKTEPKCICPTGWTGIYCDIPDVSCEVAASQRGVAVQDLCQHAGICINTGFSHRCQCRQGYIGSYCEGELDECASNPCQNSATCVDRHGGYECKCLPGYQGVNCEYEIDECQIQPCHNGGTCVDLVNQFRCSCPPGTRGPLCEENIDDCAPSSEGPHCFNGGRCLDKIGGYSCECLPGFAGERCEGDVNECLSNPCSAKGSLDCIQLDNNYLCKCKPGFTGRHCETIQDLCPTRPCLNGGTCAVAVNMPEGFTCQCPPGFSGSKCQYSNNTCGHYKCKVGENCIKTPLGPRCYCPTGPAGNACQSKLGCTSQPCKNNGVCQRKDQPPYYTCNCPNGIVGLQCEILLIDGCHLHHCPDKARDGYCDQECNTHECLWDGGDCSLTMEDPWANCSSSLKCWEYFNGQCDELCNTPECLFDNFECQEKESICKYDKYCEDHYANGHCDKSCNTKECGWDGLDCSTDKPENLAEGTLVIVVLMPPKELLKNSRNFLRELGSILRTNLRIKRNPDGSPMVFPYFREKSSAQRSRRSLLELRVVRELEEQPIGSKVSLEIDNQQCVLDSDQCFKTTDSAAAMLAAHAVQGTLNYPLVSVGGKSNFIICIKKLNKKIKNMLTERGKIWYSYKLFLLFRNLSVPIVDGNLLDSNQNDHWSDDRGPQPKKSKSEGQALLSGGDDQVDSRQWTQQHLVAADIRMTPSLALTPPQAEQDMDVIDVNVRGPDGCTPLMLASLRMGSPHIEEDDEEAEDPSANVITDLIYQGACLQAQTDRTGETALHLAARYSRADAAKRLLDAGADANSQDSMGRTPLHAAVSADAQGVFQILIRNRVTDLDARMNDGTTPLILAARLAVEGMVADLINCQADVNAVDDHGKSALHWAAAVNNVEATIVLLKNGANRDMQDNKEETPLFLAAREGSFEAAKMLLDYFANREITDHMDRLPRDIAKDRMHHDIVRLLDEYNLVHSPQGQPGTMLSNSLSPAVCGSNRSFLNLKHAAQTKKARRPSAKSVAPRSLPNLAKEPKDTKNRRRKKSDTDSKAQLSESSVTLSPVDSLESPHATSSPTITSPGALHTSPGQMIAASTLQPPRTTMSLTNLQPVGCAANNMLPSVGQLLSHSAQNNVLTAQRQLTMSSDWLSRMERNDTQYNEMFGIVHHDTNNHSCIPQQNDIKPTLHMGVARDALPPIMTFQLIPKSGMNQQSGIQTLVQQASHGQNVAAMYQIPDRARITGSSVPIAMMHQHDGQLSQTMLTAYHPLQNPMGKYPTPPSQHSYTSTDKTPNHNGHLPGEHPYLTPSPESPDQWSSSSPNSASDWSDVTTSPTPNGNQRMPATHMPEQSHNGMQIYA

SEQ ID NO: 49 - protein, 2432 aa, Gallus gallus
MARGAGPAFAALFGLVLAVLSRAEPAAALQCMDDSKPCVNEGKCIPYQNGTGYCKCREGYLGDYCQYRNPCESNTCKNGGTCETTSLIGKATCKCAPGFTGEDCQYSESHICYVSQPCLNGGTCHPHSQETYECVCPPGYTGKDCQWIDACTSQPCANGSTCTVSGHKFSCICQSGYTGQKCEIDVNECATSGLCHHGGTCINLPGSFRCQCKPGYTGHRCESNYVPCSPSPCMNGGTCHQTSDFTFECNCLPGFKGSICEKNVDDCPNHNCQNGGICVDGVNTYNCRCPPQWTGQFCTEDVDECQLQPNACQNGGTCTNHNGGYACVCVNGWSGDDCSKNIDDCFTASCANGSTCIDRVASFSCICPEGKAGLLCHLDDACVSNPCQKGALCDTNPVNGHYICTCPQGHKGADCTEDVDECAMANSNPCEHAGKCVNTEGSFHCECLKGYTGPRCEMDINECHSNPCQNDATCLDKIGGFTCLCMPGFKGVHCEEDIDECLSNPCVNNGECLDKVNRFLCVCPPGFSGAVCQIDIDDCSSTPCLNGAKCIDHPNGYECQCATGFTGVLCEENINNCDPDPCHHGECQDGIDSYTCICNPGYMGAICSEQINECHSNPCLHQGRCIDLVNGYQCNCLPGTSGVNCENNFDDCASNPCVHGDCIDGINRYNCACKPGFTGPRCNVDIDECASSPCNNGGTCINEVNGFRCVCPEGYHHPHCQSQADGCLSNPCVHGNCTHIVSGYKCVCDPGWIGDYCSTEGNECKSNPCQNGGTCEDLLNGYRCTCRKGFKGVNCQVVVAPCSPDPCENSGICQESPDSEGYTCQCAPGWEGERCTVDIDECLSKPCKNHALCHNIQGSYLCECRPGFTGGDCDSNIDDCLSNPCQNGASCVDGINSFSCICLPGFHGDKCQTDTNECLSEPCRNGGTCTHYVNSYTCKCQPGFEGTNCENNIDECTESSCFNGGTCVDGINSFTCQCPVGFTGPFCLMEINECDSHPCLNKGSCVDSLGKYRCICPLGYTGKNCQTPMDLCSKSPCKNKGTCFQSGAQTRCDCPSGWTGAYCDVPNVSCQVAASQRGITVDQLCQHSGHCLNVGNTHRCQCRVGYTGSYCEEQLDECDSSPCQNGATCRDHLGGYQCECVPGYQGVNCEYEVDECQFQPCQNGGTCIDLVNHFRCSCPPGTRGRLCEENVDDCISESGGPRCFNGGQCIDQIGGYSCLCLPGFAGERCEGDINECLSNPCNPRGSLDCIQLINDYTCICRSAFTGRHCESVIDVCPRKPCQNGGTCAVASNMPDGFICQCPPGYSGAKCEFSSHSTCGQVKCKKGEQCIHTSSGPRCYCPRLAVGEECQTNTGCASAPCQNGGSCHPRSQPPYYYCQCPAHAQGSQCEQLVHPSQEPLGCLDSQCAEKARDGYCDEDCNTHACQWDGGDCSLTMEDPWANCSSSLRCWMLFNGQCDEFCNTPECLFDNFECQQNSRMCKYDKYCADHYGDGRCDQGCNSEECGWDGLDCAGDKAERLAEGTLIIVVLMRPDELLRDVRSFLRTLGTLLHTNLRIKLDSQGNPMVFPYYGEKSAARSRRSVVVVRKHRELEQEVIGTRVFLEIDNRQCAEDSEQCFHNTEAAAALLAAQAIKGMLPYPFVSVQSEPLLPPKTQLLYLLAVAALIILLILLLGVMMAKRKRKHGSLWLPEGFILRRDPSNHKRREPVGEDAVGLKNLSVQIPEGNMADSGPTEHWAGDGGPQPKRVKTEDQALLPEADEQIDQRQWTQQHLEAADVCGSTSLALTPPQADQEVDVLDVNVRGPDGCTPLMLASLRVGGSDISEDDEDGEDSSANIITDLIYQGANLQAQTDRTGEMALHLAARYSRADAAKRLLDAGADANARDNMGRTPLHAAVAADAQGVFQILIRNRVTDLDARMNDGTTPLILAARLAVEGMVAELINCQADVNAVDDHGKSALHWAAAVNNVEATLVLLKNGANRDMQDNKEETPLFLAAREGSFEAAKILLDHFANRDITDHMDRLPRDVAQDRMHHDIVQLLNEYNVAHSPTGHPGAMLNSALSPVICGPNRSFLNLKHASLSKKSRKPNAKGIMPTNLTKDAKRRRKKSLSESKGQFSESSVTLSPVDSLESPHAFASEPTSSPVMPSPGVLHSSPSSLLTAPSVQAAHSMSFSNLHEMQPLGRGSSTVLPSVSQLLSQHRTTPPSSGLGRLRPANVSTEWMNRMEMNESQYNEMFGMVPPVMHSHPSVSQQSGLVQADAKHLGVSRESLPPIMTFQLVPKGGINQQALPQQAQSNCAQNMAGPLSSMYQISDLAQLPSASFSMAAIPQQDGQVPQTILPAYHQFQSSMGKYPTPPSQHSCYSSATERTPSHNRHLQGEHPYLTPSPESPDQWSSSSPHSASDWSDVATSPGNNQRGPAAAHVPEQQRNNMQVYA

SEQ ID NO: 50 - protein, 2472 aa, Oryctolagus cuniculus
MPGPRRAALWALLALWLSRAAPARALQCRDGYEPCVNEGICVTYHNGTGYCKCPEGFLGEYCQHRDPCEKNRCQNGGTCVAQAMLGKATCRCAPGFTGEDCQYSTSHPCFVSRPCLNGGTCHTHSRDTFECTCQVGFTGKLCQWTDACLSHPCANGSTCTTVANQFSCKCLPGFTGQKCETDVNECDIPGQCQHGGTCLNLPGSYQCQCPQGFTGQHCDSPYVPCAPSPCVNGGTCRQTGDFTFECNCLPGFEGNTCERNIDDCPNHKCQNGGVCVDGVNTYNCRCPPQWTGQFCTEDVDECLLQPNACQNGGTCTNRNGDYGCVCVNGWSGDDCSENIDDCAFASCTPGSTCIDRVASFSCMCPEGKAGLLCHLDDACISNPCHKGALCDTNPLNGQYICTCPQGYKGADCTEDVDECTMANSNPCEHAGKCMNTDGAFYCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCGENIDNCDPDPCHHGQCQDGIDSYTCICNPGYMGAICSDQIDECYSSPCLNDGRCIDLVNGYQCNCQPGTSGVNCEINFDDCASSPCVHGVCVDGINRYSCVCSPGFTGQRCNIDIDECASNPCRKGATCVNDVNGFRCICPEGPHHPSCYSQVNECLSNPCIHGNCTGGLSGYKCLCDAGWVGINCEVDKNECLSNPCQNGGTCDNLVNGYRCTCEKGFKGYNCQVNIDECASNPCLNQGTCFDDISGYTCHCVLPYTGNNCQTVLAPCSPNPCENGAVCKEAPDFESYTCVCAPGWQGQRCTIDIDECVSKPCLNHGLCHNTQGSYMCECPPGFSGMDCEEDINDCLANPCQNGGSCMDRVNTFSCLCLPGFIGDKCQTDMNECLSEPCKNGGTCSDYVNSYTCKCQAGFDGVHCENNIDECTESSCFNGGTCVDGINSFSCLCPVGFTGPFCLHEINECNSHPCLNEGTCVDGLGTYRCTCPLGYTGKNCQTLVNLCSRSPCKNKGTCVQEKAESRCLCPSGWAGAYCDVPSVSCSIAALRRGVSVAHLCQHSGVCIDAGSTHHCQCPLGYTGSYCEEQLDECASNPCQHGATCSDFIGGYRCECVPGYQGVNCEYEVDECQNQPCQNGGTCIDLVNHFKCSCPPGTRGLLCEENIDDCAGGPHCLNGGQCVDRIGGYSCRCLPGFAGERCEGDINECLSSPCSSEGSLDCIQLTNNYLCVCRSAFTGRHCETFVDVCPQMPCMNGGTCAVASNMPDGFICRCPPGFSGARCQSSCGQVKCRRGEQCVHTASGPRCFCPNPQDCDAGCASSPCQHGGSCYPQRQPPYYSCHCAPPFWGSHCELYSAPTSSPPATCLSQYCADKARDGVCDEACNSHACQWDGGDCSLTMEDPWANCSSPLPCWDYINNQCDELCNTAECLFDNFECQGNSKTCKYDKYCADHFKDNHCDQGCNSEECGWDGLDCAADRPENLAEGTLVIVVLMPPEQLLQDARSFLRALGTLLHTNLRIKRDSQGDLMVYPYYGEKSAAMKKQRMTRRSLPDEQEQEVAGSKVFLEIDNRQCVQDSDQCFKNTDAAAALLASHAIQGTLSYPLVSVVSESLAPKPTQLLYLLAVAVVIILFIILLGVIMAKRKRKHGSLWLPEGFTLRRDSSNHKRREPVGQDAVGLKNLSVQVSEANLIGSGTSEHWVDDEGPQPKKAKAEDEALLSEEDDPIDRRPWTQQHLEAADIRRTPSLALTPPQAEQEVDVLDVNVRGPDGCTPLMLASLRGGSSDVSDEDEDAEDSAANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRPFLSLKHTPMGKKPRRPNAKSAIPTSLPNLAKEAKEAKGSRRKKSLSEKVQLSESSVTLSPVDSLESPHTYVSDTTSSPMITSPGILQASPNPMLATAAPSAQVHAQHALSFSNLHEMQPLAHGGASTVLPSVSQLLSHHHIVPPGSGSAGSLGRLHPVTVPADWMNRVEVNDTQYNEMFGMVLAPAEGTHPGMAPQSRPPEGKHITTPREPLPPIVTFQLIPKGSIAQPTGAPQTQSSCPPAVAGPLPTMYQIPEMARLPSVAFPTAMMPQQDGQVAQTILPAYHPFPASVGKYPTPPSQHSYASSSAAERTPSHSGHLQGEHPYLTPSPESPDQWSSSSPHSASDWSDVTTSPTPGGAGGGQRGPGTHMSEPPHSNMQVYA

SEQ ID NO: 51 - protein, 2431 aa, Macaca mulatta
MPALRPALLWALLALWLCRAAPARALQCRDGYEPCVNEGMCVTYHNGTGYCKCPEGFLGEYCQHRDPCEKNRCQNGGTCVAQAMLGKAMCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQHCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLTAPCNSFLLTCYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNIDECTESSCFNGGTCVDGINSFSCLCPVGFTGLFCLHEINECSSHPCLNEGTCVDGLGTYHCSCPLGYTGKNCQTLVNLCSRSPCKNKGTCIQDKAESRCRCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCVDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPNPRDCESGCASSPCQHGGSCHPQRQPPYYSCQCAPPFWGSRCELYTAPPSTPPATCLSQYCADKARDGVCDEACNSHACQWDGGDCSLTMENPWANCSSPLPCWDYINNQCDELCNTAECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSIPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGSGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKNTMPTSLPNLAKEAKDAKGSRRKKSLSEKVQLSESSVTLSPVDSLESPHTYVSDTTSSPMITSPGILQASPNPMLATAAPPASVHAQHALSFSNLHEMQPLAHGASTVLPSVSQLLSHHHIVPPSSGSAGSLSRLHPVPVPADWMNRMEVNETQYNEMFGMVLAPAEGTHPSIAPQSRPPEGKHITTPREPLPPIVTFQLIPKGSIAQPAGAPQPQSTCPPAVTGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 52 - protein, 2471 aa, Macaca mulatta
MPALRPALLWALLALWLCRAAPARALQCRDGYEPCVNEGMCVTYHNGTGYCKCPEGFLGEYCQHRDPCEKNRCQNGGTCVAQAMLGKAMCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQHCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNIDECTESSCFNGGTCVDGINSFSCLCPVGFTGLFCLHEINECSSHPCLNEGTCVDGLGTYHCSCPLGYTGKNCQTLVNLCSRSPCKNKGTCIQDKAESRCRCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCVDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPNPRDCESGCASSPCQHGGSCHPQRQPPYYSCQCAPPFWGSRCELYTAPPSTPPATCLSQYCADKARDGVCDEACNSHACQWDGGDCSLTMENPWANCSSPLPCWDYINNQCDELCNTAECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSIPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGSGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKNTMPTSLPNLAKEAKDAKGSRRKKSLSEKVQLSESSVTLSPVDSLESPHTYVSDTTSSPMITSPGILQASPNPMLATAAPPASVHAQHALSFSNLHEMQPLAHGASTVLPSVSQLLSHHHIVPPSSGSAGSLSRLHPVPVPADWMNRMEVNETQYNEMFGMVLAPAEGTHPSIAPQSRPPEGKHITTPREPLPPIVTFQLIPKGSIAQPAGAPQPQSTCPPAVTGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 53 - protein, 2471 aa, Macaca mulatta
MPALRPALLWALLALWLCRAAPARALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQHCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNIDECTESSCFNGGTCVDGINSFSCLCPVGFTGLFCLHEINECSSHPCLNEGTCVDGLGTYHCSCPLGYTGKNCQTLVNLCSRSPCKNKGTCIQDKAESRCRCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCVDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPNPRDCESGCASSPCQHGGSCHPQRQPPYYSCQCAPPFWGSRCELYTAPPSTPPATCLSQYCADKARDGVCDEACNSHACQWDGGDCSLTMENPWANCSSPLPCWDYINNQCDELCNTAECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSIPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGSGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKNTMPTSLPNLAKEAKDAKGSRRKKSLSEKVQLSESSVTLSPVDSLESPHTYVSDTTSSPMITSPGILQASPNPMLATAAPPASVHAQHALSFSNLHEMQPLAHGASTVLPSVSQLLSHHHIVPPSSGSAGSLSRLHPVPVPADWMNRMEVNETQYNEMFGMVLAPAEGTHPSIAPQSRPPEGKHITTPREPLPPIVTFQLIPKGSIAQPAGAPQPQSTCPPAVTGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 54 - protein, 2006 aa, Pan troglodytes
MQPPSLLLLLLLLLCVSVVIPRGLLCGSFPEPCANGGTCLSLPLGQGTCQCAPGFLGETCQFPDPCQNAQLCQNGGSCQALLPAPLGLPSSPSPLTPSFLCTCLPGFTGERCQAQLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPGKDSTFHLCLCPPGFLGLDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLKDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSFPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKIRPSCADSPCRNRATCQDSPQGPRCLCPTGYTGGSCQTLMDLCAQKPCPSNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPPPRGRRFSAGMRGPRPNPAIMRGRYGVAAGRGGRVSTDDWPCDWVALGACGSASNIPIPPPCLTPSPERGSPQLDCGSPALQEMPINQGGEGKKSKNTW

SEQ ID NO: 55 - protein, 2471 aa, Macaca mulatta
MPALRPALLWALLALWLCRAAPARALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQHCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNIDECTESSCFNGGTCVDGINSFSCLCPVGFTGLFCLHEINECSSHPCLNEGTCVDGLGTYHCSCPLGYTGKNCQTLVNLCSRSPCKNKGTCIQDKAESRCRCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCVDRIGGYSCRCLPGFAGERCEGDINECLSNPCSSEGSLDCIQLTNDYLCVCRSAFTGRHCETFIDVCPQMPCLNGGTCAVASNMPDGFICRCPPGFSGARCQSSCGQVKCRKGEQCVHTASGPRCFCPNPRDCESGCASSPCQHGGSCHPQRQPPYYSCQCAPPFWGSRCELYTAPPSTPPATCLSQYCADKARDGVCDEACNSHACQWDGGDCSLTMENPWANCSSPLPCWDYINNQCDELCNTAECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSIPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGSGTSEHWVDDEGPQPKKAKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKNTMPTSLPNLAKEAKDAKGSRRKKSLSEKVQLSESSVTLSPVDSLESPHTYVSDTTSSPMITSPGILQASPNPMLATAAPPASVHAQHALSFSNLHEMQPLAHGASTVLPSVSQLLSHHHIVPPSSGSAGSLSRLHPVPVPADWMNRMEVNETQYNEMFGMVLAPAEGTHPSIAPQSRPPEGKHITTPREPLPPIVTFQLIPKGSIAQPAGAPQPQSTCPPAVTGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 56 - protein, 2276 aa, Mesocricetus auratus
MGPGARGRRRRRRLMALPPPPPPMRALPLLLLLAGPGAAASPCLDGSPCANGGRCTQQPSREAACLCLPGWVGERCQLEDPCHSGPCAGRGVCQSSVVAGTARFSCRCPRGFRGPDCSLPDPCLSGPCAHGAPCSVGSDGRFACSCPPGYQGRSCRSDVDECRGGGPCRHGGTCLNTPGSFRCQCPLGYTGLLCESPIVPCAPSPCRNGGTCRQSSDTTYDCACLPGFEGQNCEVNVDDCPGHRCLNGGTCVDGVNTYNCQCPPEWTGQFCTEDVDECQLQPNACHNGGTCFNLLGGHSCVCVNGWTGDSCSQNIDDCATAVCFHGATCHDRVASFYCACPMGKTGLLCHLDDACVSNPCHEDAICDTNPVSGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCERNVDDCSPDPCHHGRCVDGIASFSCACAPGYTGTRCESQVDECRSQPCRYGGKCLDLVDKYLCRCPPGTTGVNCEVNIDDCASNPCTFGVCHDGINRYDCVCQPGFTGPLCNVEINECASSPCGDGGSCVDRENGFRCLCPPGSVPPLCLPANHPCAHKPCSHGVCQDAPGGFRCVCEPGWSGPRCSQSLAPDACESQPCQAGGTCTSDGIGFRCTCPPGFQGRQCEVLSPCTPSLCEHGGHCESGPGQLTVCSCPPGWQGSRCQQDVDECAGASPCESHGTCTNLPGSFRCICHEGYTGPFCDQDIDDCDPNPCLNGGSCQDGVGSFSCSCLSGFAGPRCAWDVDECLSSPCGPGTCSDHVSSFTCACPPGYGGFHCESDLPDCSPSSCFNGGTCVDGVNSFSCLCRPGYTGTHCQHEADPCLSRPCLHGGTCSPTHPGFQCACQEGFTGSHCQNLVDWCSQSSCQNGGRCVQPGAYCICPPGWSGRLCDIQSLPCKEAAARMGVRLEQLCQAGGQCVDKGHSHYCVCPEGRTGSYCEQEMDPCTAQPCHHGGTCRGYMGGYVCECPAGYSGDRCEDDVDECASQPCQHGGSCIDLVARYLCSCPPGTLGVLCEINEDDCGPGSSLDSGLRCLHNGTCVDLVGGFRCNCPPGYTGLHCEADINECRPGACHAAHTRDCLQDPGGHFRCLCHPGFTGPRCQTALSPCESQPCLHGGQCRPSSGQGGGLTFTCHCVQPFWGLRCERVARTCRELQCPVGSPCQQTSRGPRCACPPGLSGPFCRVSRASPSGATNASCAAAPCLHGGSCLPVQIAPFFRCACAPGWAGPRCETPSTVPEAPEEPRCPRAACQAKRGDQNCDRECNSPGCGWDGGDCSLNVDDPWRQCEALQCWRLFNNSRCDPACSSPACLYDNFDCYAGGRERTCNPVYEKYCADHFADGRCDQGCNTEECGWDGLDCASEVPALLARGVLVLTVLLPPEELLRSSADFLQRLSAILRTSLRFRLDARGQAMVFPYHRPRPGSESRVRRELGPEVIGSVVMLEIDNRLCLQSPENDHCFPDAQSAADYLGALSAVERLDFPYPLRDVRGEPLEPPEQSVPLLPLLVAGAVFLLVIFILGVMVARRKREHSTLWFPEGFSLHKDIAVGHKGRREPVGQDALGMKNMAKGESLMGEVATDWMDAECPEAKRLKKDPYACDTLLVPADGFTPLMLASFCGGALEPMPAEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSFEAAKLLLDHFANREITDHLDRLPRDVAQERLHQDIVRLLDQPSGPRSPPGPHGLGPLLCPPGAFLPGLKAVQSGAKKSRRPPGKTGLGPQGTRGRGKKLTLACPGPLADSSVTLSPVDSLDSPRPFGGPPASPGGFPLEGPYATTATAVSLAQLGTSRAGPLGRQPPGGCVLSLGLLNPVAVPLDWARLPPPAPPGPSFLLPLAPGPQLLNPGTPVSPQERPPPYLAAPGHGEEYPAAGTHSSPTKARFLRVPSEHPYLTPSPESPDHWASPSPPSLSDWSDSTPSPAAAAGATAAGALPAQPHPMSVPSLPQSQTQLGSQPEVTPKRQVMA

SEQ ID NO: 57 - protein, 2471 aa, Pan troglodytes
MPALRPALLWALLALWLCCAAPAHALQCRDGYEPCVNEGMCVTYHNGTGYCKCPEGFLGEYCQHRDPCEKNRCQNGGTCVAQAMLGKAMCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECSMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGNCMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGSGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 58 - protein, 2471 aa, Ovis aries
MPALRPAPLWALLALWLCRAAPARALQCRDGYEPCVNEGICVTYHNGTGYCKCPEGFLGEYCQHRDPCEKNRCQNGGTCVAQAMLGKATCRCALGFTGEDCQHSTTHPCFVSQPCLNGGTCHVLSRDTYECTCQVGFTGKLCQWTDACLSHPCANGSTCTTVANQFSCTCLAGFTGQKCEADVNECDIPGQCQHGGTCLNLPGSYQCQCPQGFTGQHCDSPYVPCAPSPCVNGGTCRQAGDFTFECSCLPGFEGVTCERNIDDCPNHKCQNGGVCVDGVNTYNCRCPPQWTGQFCTEDVDECLLQPNACQNGGTCTNRNGGYGCVCVNGWSGDDCSENIDDCAFASCTPGSTCIDRVASFSCMCPEGKAGLLCHLDDACISNPCHKGALCDTNPLNGQYICTCPQGYKGSDCTEDVDECAMANSNPCEHAGKCVNTDGAFHCECLKGYAGPRCEMDINECHSDPCKNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNEGRCIDLVNGYQCNCQPGTSGVNCEINFDDCASNPCVHGVCMDGVNRYSCVCSPGFTGQRCNIDIDECASNPCRKGATCINDVNGFRCICPEGPHHPSCYSQVNECLSNPCVHGNCTGGLTGYKCLCDAGWVGINCEVDKNECLSNPCQNGGTCDNLVNGYRCTCKKGFKGYNCQVNIDECASNPCLNQGTCFDDVSGYTCHCVLPYTGKNCQTVLAPCSPNPCENAGVCKEAPNFESYSCLCAPGWQGQRCTIDIDECVSKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNIDECTESSCFNGGTCIDGINSFSCLCPVGFTGSFCLHEINECNSHPCLNEGVCVDGLGTYRCICPLGYTGKNCQTLVNLCSRSPCKNKGTCIQDKAESRCLCPSGWAGAYCDVPSVSCEVAASRRGVPVDRLCQHSGVCISAGNSHHCQCPLGYTGSYCEDQLDECSSNPCQHGATCRDFIGGYRCECVPGYQGVNCEYEVDECQNQPCQNGGTCIDLVNHFKCSCPPGTRGLLCEENIDDCARGPHCLNGGQCVDRIGGYSCRCLPGFAGERCEGDINECLSSPCSSEGSLDCIQLTNDYLCVCRSTFTGRHCETFVDVCPQMPCLNGGTCAVASNMPDGFICRCPPGFSGVRCQSSCGQVKCRRGEQCVHTASGPRCFCPNPQDCDSGCASSPCQHGGSCHPQRQPPYYSCQCAPPFRGSHCELYSTPTSTPPATCLSQYCADKARDGICDDVCNSHACQWDGGDCSLTMEDPWANCSSPLPCWEYINNQCDELCNTAECLFDNFECQKSSKTCKYDKYCADHYEDNHCDQGCNSEECGWDGLDCAADRARKPGRGHPRHCGADAPEQLLQDARRFLRALGTLLHTNLRIKRDAQGELMVYPYYGGKSAAMKKQRLTRRSLPGDEEQEVAGSQVFLEIDNRQCVQDSDQCFKNTDAAAALLASHAIQGTLSYPLVSVVSESLAPKRTPLLYLLAVAVVIILFIILLGVIMAKRKRKHGSLWLPEGFTLRRDSSNHKRREPVGQDAVGLKNLSVQVSEANLIGSGTSEHWVDDEGPQPKKAKAEDEALLSEEDDPIDRRPWTQQHLEAADIRRTPSMALTPPQAEQEVDVLDVNVRGPDGCTPLMLASLRGGSSDMSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVVRDRMHHDIVRLLDEYNVTPSPPGTVLTSALSPVICGPNRSFLSLKHTPMGKKSRRPNTKSAVPTSLPNLAKEAKDAKGNRRKKSLSDKGQLSESSVTLSPVDSLESPHTYVSDTTSSPMITSPGILQASPTPMLATAAPTGPVHAQHALSFSNLHEMQPLAHGANTVLPSVSQLLSHHHIVPPGSSTAGSVGRLHPVPVPADWMNRVEVNESQYNEMFGMVLAPAEGTHPGIAPQSRPPEGKHLTTPREPLPPIVTFQLIPKGSIAQPTGAAQPPSNCPPAVAGTLPTMYQIPEMARLPSMAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPRSNMQVYA

SEQ ID NO: 59 - protein, 2531 aa, Macaca mulatta
MPPLLAPLLCLALLPALAARGPRCSQPGETCLNGGKCEAANGTEACVCGGAFVGPRCQDPNPCLSTPCKNAGTCHVVDRGGMADYACSCPLGFSGPLCLTPLDNACLTNPCRNGGTCDLLTLTEYKCRCPPGWSGKSCQQADPCASNPCANGGQCLPFEASYICHCPPSFHGPTCRQDVNECGQNPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGRCWHRGCIGEFQCICMPGAPGGRCTEGPWWLGYWAQGYEGVHCEVNTDECASSPCLHNGRCLDKINEFQCECPTGFTGHLCQYDVDECASTPCKNGAKCLDGPNTYTCVCTEGYTGMHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCQDGINGFTCRCPEGYHDPTCLSEVNECNSNPCVHGACRDSLNGYACDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRESEDYESFSCVCPTGWQGETCEVDINECVVSPCRHGASCQNTHGGYRCHCQAGYSGRNCETDIDDCRPNPCHNGGSCTDGINTAFCDCLPGFQGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVAQLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPQIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPEALLGQVKASLLPGGGGGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGSRLAFEAGPPRLSHLPVASGTSTVLGCSSGGAMNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPPNIQQQPNLQPPPPPPQPHLGVSSAASGHLGRSFLGGEPSQADVQPLGPSSLAVHTILPQESPALPTSLPSSLVPPVTAAQFLTPPSQHSYSSSPVDNTPSHQLQVPEHPFLTPSPESPDQWSSSSPHSNVSDWSEGVSSPPTSMQSQIARIPEAFK

SEQ ID NO: 60 - protein, 2354 aa, Xenopus tropicalis
SFARCSSSYFGERCQYPNPCALKNQCMNFGTCEPVLLGNAIDFTCHCPVGFTDKVCLTPVDNACVNNPCRNGGTCELLSSVSDYRCRCPPGWTGDSCQQADPCASNPCANGGKCLPFETQYICKCPSGFHGATCKQDINECSQNPCRNGGQCLNEFGSYRCNCQNRFTGRNCEEPYVPCNPSPCLNGGTCRQTDDTSYECTCLPGSFSGQNCEENIDDCPSNNCRNGGTCVDGVNTYNCQCPPDWTGQYCTEDVDECQLMPNACQNGGTCHNTYGGYNCVCVNGWTGEDCSENIDDCANAACHSGATCHDRVASFFCECPHGRTGLLCHLDNACISNPCNEGSNCDTNPVNGKAICTCPPGYTGPACNNDVDECSLGANPCEHGGRCTNTLGSFQCNCPQGYAGPRCEIDVNECLSNPCQNDATCLDQIGEFQCICMPGYEGLYCETNIDECASNPCLHNGKCVDKINEFHCECPTGFNGNLCQHDVDECASTPCKNGAKCLDGPNSYTCQCTEGFTGRHCEQDINECIPDPCHYGTCKDGIATFTCLCRPGYTGRLCDNDINECLSQPCQNGGQCTDRENGYICTCPKGTTGVNCETNLDDCASNPCDYGKCIDKIDGYECTCEPGYTGKMCNINIDECASNPCRNGGTCKDKINGFTCVCPDGYHDHMCLSEVNECNSNPCIHGTCHDGINGYKCDCDAGWSGSNCDVNNNECESNPCMNGGTCKDMTGAYICTCRAGFSGPNCQTNINECASNPCLNRGTCIDDVAGYKCNCMLPYTGAICEAVLAPCSGSPCKNGGRCKESEDYETFSCECPPGWQGQTCEIDMNECVNRPCRNGAMCQNTNGSYKCNCKPGYAGRHCETDIDDCQPNPCHNGGSCSDGINMFFCNCPAGFRGPKCEEDINECASNPCKNGANCTDCVNSYTCTCQPGFSGIHCENNTPDCTESSCFNGGTCIDGINTFSCQCPPGFTGNYCQHDINECDSKPCLNGGTCQDSYGAYKCTCPQGYTGLNCQQNLVRWCDSSPCKNGGKCWQTNNFYRCECKSGWTGVYCDVPSVSCEVAAKQQGVDIAHLCRNSGMCVDTGNTHFCRCQAGYTGSYCEEQVDECSPNPCQNGATCTDYLGGYSCECVAGYHGVNCSEEINECLSHPCHNGGTCIDLINTYKCSCPRGTQGVHCEINVDDCTPFYDSVSLEPKCFNNGKCFDRVGGYNCICPPGFVGERCEGDVNECLSNPCDPRGTQNCIQLVNDYRCECRQGFTGRRCDSVVDGCKGLPCRNGGTCAVASNTERGFICKCPPGFDGATCEYDARTCGNLRCQNGGTCISVLKSSKCVCSEGYTGATCQYPVVSPCASRPCYNGGTCQFSPEEPFFQCFCPTNFNGLFCHILDYGFIGGLGKNITPPDNEEICENEQCAELADNKICNANCNNHACGWDGGDCSLNFNDPWKNCTQSLQCWKYFNDGKCDSQCNNSGCLYDGFDCQKVEVQCKSINNTFFPWYCRDHFQDGHCDQGCNNAECEWDGLDCDNMPENLAEGTLLIVVLMPPEKLKNNSVNFLRELSRVLHTNVVFKKDSKGEYKIYPYYGNEEELKKHHIKKRSAASWSDAPTAIFSTMKESVLPGRRRRELDQMEVRGSIVYLEIDNRQCYKSSSQCFTSATDVAAFLGALATHGNLNIPYKIEAVKSEIVETAKPPPPLYAMFSMLVIPLLIIFVIMVVIVNKKRRREHGQLWFPEGFIPKEPSKKKRREPLGEDSVGLKPLKNLTDGSFMDDNQNEWGDEETLENKRFRFEEQVMLPELVDDQTDHRQWTQQHLDAADLRIPSMAPTPPQGEIDADCMDVNVRGPDGFTPLMIAACSGGGLETGNSEEEEDASANMISDFIGQGAQLHNQTDRTGETALHLAARYARADAAKRLLESSADANVPDNMGRTPLHAAVAADAQGVFQILIRNRATDLDARMCDGTTPLILAARLAVEGMVEELINAHADVNAVDEFGKSALHWAAAVNNVDAAAVLLKSSANESIGFGQLRGVVPVDSLESPHGYLSDVASPPLMTSPFQQSPSMPLNHLTSMQDSHLGLNHMTMANKQEMASNRMAFDGMTPRLTHLNVSSPNTIMTNGSMHFTVGGAPAMNGQCDWFARLQNGMVQNQYNPIRNGIQQGNAQQALQHGLMSSLHNGLPATTLSQMMTYQAMPNTRMANQPHLMQAQQMQQQQNLQLHQSVQQQQHQNSNATSTHIGSPFCSNDISQTDLQQMSGNNIHSVMPQDTQIFTNSLPPTLTQSMATTQFLTPPSQHSYSSPMDNTPSHQLQVPDHPFLTPSPESPDQWSSSSPHSNMSDWSEGISSPPTSMQPQRTHIPEAFK

SEQ ID NO: 61 - protein, 2324 aa, Canis lupus familiaris
MDGWMRGAARPSRRPGSFSVGFGLSPHPGPSLGGAGPSFPAAFLQAAGGVQVWVCGGEPHVPGRLRLSAQVHDGRPGVSSSGASRRLPPPRPGWPRAAEPGRPGTAAGGEAGGEAEGPAAASAEIPPRAARAGASSCGKPLGAAGGGSGPATGGGACGEEAAEAEGHTRLLRRSAEKVSAELRAAADRPRRPGSGRRVAAGRGGRQAADLSARSVRPLATGTSERKNVRGPSLGTPSSYGSARAVAAAAAAATEKMPGLSPARLWALLALGLSCAAPARALQCRDSYEPCVNEGVCVTYHNGTGYCKCPEGFLGEYCQHRDPCERNRCQNGGTCVAQAMLGKATCRCALGFTGDDCQYSTTHPCFVSHPCLNGGTCHMHSRDDYECTCQVGFTGKLCQWTDACLSHPCANGSTCTTVANQFSCKCLTGFTGQKCEIDVNECDIPGQCQHGGTCLNLPGSYQCQCPQGFTGKHCDSPYVPCAPSPCVNGGTCRQTGDFTFECNCLPGFEGITCERNIDDCPNHKCQNGGVCVDGVNTYNCRCPPQWTGQFCTEDVDECLLQPNACQNGGTCTNRNGGYGCVCVNGWSGDDCSENIDDCAFASCTPGSTCIDRVASFSCMCPEGKAGLLCHLDDACISNPCHKGALCDTNPLNGQYICTCPQGFKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCVHGVCMDGINRYSCVCSPGFTGQRCNIDIDECASNPCRKGATCINDVNGFRCLCPEGPHRPSCYSQVNECLSSPCIHGNCTGGPSGYKCLCDAGWIGINCEVDKNECLSNPCQNGGTCDNLVNGYRCTCKKGFKGYNCQVNIDECASNPCLNQGTCFDNISGYTCHCVLPYTGKNCQTVLAPCSPNPCENAAVCKEAPDFESYTCLCAPGWQGQRCTIDIDECVSKPCMNHGLCHNTQGSYMCECPPGFSGMDCEDDIDDCLANPCQNGGSCVDGVNTFSCLCHPGFIGDKCQTDMNECLSEPCKNGGTCSDYVNSYTCKCQAGFDGVHCENNIDECTESSCFNGGTCVDGINSFSCLCPLGFTGPFCLHEINECNSHPCLNEGICVDGLGTYRCTCPLGYTGKNCQTLVNLCSRSPCKNKGTCIQEKAESRCLCPSGWAGAYCDVPNVSCEVAALHRGVSTDHLCQHSGICINAGNSHHCQCPLGYTGSYCEEQLDECSSNPCQHGATCRDFIGGYRCECVPGYQGVNCEYEVDECQNQPCQNGGTCVDLVNHFKCSCPPGTRGLLCEENIDDCVGGPHCLNGGQCVDRIGGYSCRCLPGFAGERCEGDINECLSNPCSSEGSLDCIQLTNDYLCVCRSAFTGRHCETFIDVCPQMPCLNGGTCAVASNMPDGFICRCPPGFSGAKCQSSCGQVKCRRGEQCVHTASGPRCFCPNPQDCESGCASSPCQHGGSCYPQRQPPYYSCQCSPPFWGSHCELYMAPTSTPPATCLSQYCADKARDGVCDEACNSHACQWDGGDCSLTMENPWANCSSPLPCWDYINNQCDELCNTAECLFDNFECQGNSKTCKYDKYCADHFKDNHCDQGCNSEECGWDGLDCAADRPENLAEGTLVIVVLMPPEQLLQDARSFLRALGTLLHTNLHIKRDSQGALMVYPYYGEKSAATKKQRMTRRSLPGDQEQEVAGSKVFLEIDNRQCVQDSDQCFKNTDAAAALLASHAIQGTLSYPLVSVVSESLNPKPTQLLYLLAVAVVIILFIILLGVIMAKRKRKHGSLWLPEGFTLRRDSSNHKRREPVGQDAVGLKNLSVQVSEANLIGSGTSEHWVDDEGPQPKKAKAEDEALLSEEDDAIDRRPWTQQHLEAADIRRTPSLALTPPQAEQEVDVLDVNVRGPDGCTPLMLASLRGGSSDMSDEDEDGEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKTDYKEILLRKETSSNRMHHKTESLFCLLVGDKSTLAQDRVPSSGDGVCLLKPGLKSELRI

SEQ ID NO: 62 - protein, 2521 aa, Xenopus laevis
MDRIGLLVLLCFLPVLTQGLRCTQTTEMCLNGGRCETSPGGTGVCLCGSYYFGERCQFSNPCATKNQCMNLGTCEPVLQGNAVDFICHCPVGFTDKVCLTPVDNACVNNPCRNGGTCELLSSVTEYKCRCPPGWTGDSCQQADPCASNPCANGGKCLPFEIQYICRCPPGFHGATCKQDINECSQNPCKNGGQCINEFGSYRCTCQNRFTGRNCEETYVPCNPSPCLNGGTCRQTDDTSYECTCLPGFNGQNCEENIDDCPSNKCRNGGTCVDGVNTYNCQCPPDWTGQYCTEDVDECQLMPNACQNGGTCHNTYGGYNCVCVNGWTGEDCSENIDDCANAACHSGATCHDRVASFYCECPHGRTGLLCHLDNACISNPCNEGSNCDTNPVNGKAICTCPPGYTGPACNNDVDECSLGANPCEHGGRCTNTLGSFQCNCPQGYAGPRCEIDVNECLSNPCQNDATCLDQIGEFQCICMPGYEGLYCETNINECASSPCLHNGKCIDKINEFHCECPPGFKGILCQQDVDECTSTPCKNGAKCLDGPNSYTCQCTEGFTGRHCEQDINECVPDPCHYGTCKDGIATFTCLCLPGYMGRLCDKDINECISAPCQYGGQCTDRENGYICTCPKGTTGVNCETNLDDCASNPCDYGKCIDKIDGYECTCEPGYTGKMCNININECVSNPCRNGGTCKDKINGFTCVCPDGYHDHMCLSEVNECNSNPCIHGTCHDGVNGYKCDCEAGWSGSNCDINNNECDSNPCMNGGTCKDMTGAYICTCKAGFSGPNCQTNINECASNPCLNHGTCIDDVAGYKCNCMLPYTGAICEAVLAPCAGSPCKNGGRCKESEDYETFSCECPPGWQGQTCEIDMNECVNRPCRNGATCQNTNGSYKCNCKPGYTGRNCETDIDDCQPNPCHNGGSCSDGINTFFCNCPAGFRGPKCEEDINECASNPCKNGANCTDCVNSYTCTCQPGFSGIHCENNTPDCTESSCFNGGTCIDGINTFTCQCPPGFTGNYCQHDINECDSKPCLNGGTCQDSYGAYKCTCPQGYTGLNCQNLVRWCDSSPCKNGGKCWQTNNFYRCECKSGWTGVYCDVPSVSCEVAAKQQGVDIAHLCRNSGMCVDTGNTHFCRCQAGYMGSYCEEQVDECSPNPCQNGATCTDYLGGYSCECVAGYHGVNCSEEINECLSHPCQNGGTCIDLINTYKCSCPRGTQGVHCEINVDDCTPFYDSFSLEPKCFNNGKCIDRVGGYNCICPPGFVGERCEGDVNECLSNPCDSRGTQNCIQLVNDYRCECRQGFTGRRCDSVVDGCKGLPCRNGGTCAVASNTERGFICKCPPGFDGATCEYDSRTCGNLRCHNGGTCISVLKSSKCVCSEGFTGATCQYPVISPCASHPCYNGGTCQFLAEEPFFQCFCPKNFNGLFCHILDYGFPGGLGKNIIPPDNEDICENEQCAELADNKVCNANCNNHACGWDGGDCSLNFNDPWKNCTQSLQCWKYFNDGKCDSQCNNTGCLYDGFDCQKVEVQCNPLYDQYCKDHFQDGHCDQGCNNAECEWDGLDCANMPENLAEGTLMLVILMSPEKLKNNSVNFLRELSRVLHTNVVFKKDNNGEFKIYPYYGNAEELKKHHIKRSADYWSDAPSAIFSTVKESILPGRRRRELDQMEIRGSIVYLEIDNRQCYKSSSQCFNSATDVAAFLGALASLGNLDNLPYKIEAVKSEVVETPKPSSLYPMLSMLVIPLLIIFVFMVVIVNKKRRREHGQLWFPEGFIPKEPSKKKRREPLGEDSVGLKPLKNMTDVSFMDDNQNEWGDEETLENKRFRFEEQVMLPELVDDQMDHRQWTQQHLDAADLRISSMAPTPPQGEIDADCMDVNVRGPDGFTPLMIAACSGGGLETGNNEEEEDASANMISDFIGQGAQLHNQTDRTGETALHLAARYARADAAKRLLESSADANVQDNMGRTPLHAAVAADAQGVFQILIRNRATDLDARMVDGTTPLILAARLAVEGMVEELINAHADVNAVDEFGKSALHWAAAVNNVDAATVLLKNSANKDMQNNKEETPLFLAAREGSYETAKVLLDHYANRDITDHMDRLPRDIAQERMHHDIVHLLDEYNLVKSPTLHNGPLGAQTLSPICSPNGYMGNMKPSVQSKKARKPSIKANGCKEAKELKGRRKKSQDGKTTLLDSGSSGVLSPVDSLESPHGYLSDVSSPPLMTSPFQQSPSMPLNHLTSMPESHLGMNHMNMATKQEMASSNRMAFDGMTPRLTHLNASSPNTIMSNGSMHFTVGGAPAMNGQCDWLARLQNGMVQNQYNPIRSGIQQGNAQQAQALQHGLMSSLHNGLPATTLSQMMTYQAMPNTRLANQPHLMQAQQMQQQLHHNMQQQQQQHHNSNTTSTHINSPFCSSDINQTDLQQMSSNNIHSVMPQDTQIFATSLPSNLAQSMTTTQFLTPPSQHSYSSPIDNTPSHQLQVPDHPFLTPSPESPDQWSSSSPHSNMSDWSEGISSPPTSLQPQRSHIPEAFK

SEQ ID NO: 63 - protein, 2321 aa, Macaca mulatta
MGPGARGRRRRRRPMSPPPPPPPVRALPLLLLLAGPGAAVPPCLDGSPCANGGRCTQLPSREAACLCPPGWVGERCQLEDPCHSGPCAGRGVCQSSVVAGTARFSCRCPRGFRGPDCSLPDPCLSSPCAHSARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGICKDRVNGFSCTCPSGFSGSTCQLDVDECASTPCRNGAKCVDQPDGYECRCAEGFEGMLCERNVDDCSPDPCHHGRCVDGIASFSCACAPGYTGTRCESQVDECRSQPCRHGGKCLDLVDKYLCRCPSGTTGVNCEVNIDDCASNPCSFGVCRDGINRYDCVCQPGFTGPLCNVEINECASSPCGEGGSCVDGENGFRCLCPPGSLPPLCLPPSHPCAHDPCSHGICYDAPGGFRCVCEPGWSGPRCSQSLARDACESQPCRAGGTCSSDGIGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCPQSFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGENCEDDVDECASQPCQHGGSCIDLVARYLCSCPPRTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARACRELQCPVGVPCQQTPRGPRCACPPGLSGPSCRSFSGSPPGASNASCAAAPCLHGGSCRPAPLAPFFRCTCAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVAAGHKGRREPVGQDALGMKNMAKGESLMGEVATDWMDTECPEAKRLKVEELGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGTHGLGPLLCPPGAFLPGLKATQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATATGALPAQPLPLSVPSSLAQAQTQLGPQPEVTPKRQVLA

SEQ ID NO: 64 - protein, 2556 aa, Macaca mulatta
MPPLLAPLLCLALLPALAARGPRCSQPGETCLNGGKCEAANGTEACVCGGAFVGPRCQDPNPCLSTPCKNAGTCHVVDRGGMADYACSCPLGFSGPLCLTPLDNACLTNPCRNGGTCDLLTLTEYKCRCPPGWSGKSCQQADPCASNPCANGGQCLPFEASYICHCPPSFHGPTCRQDVNECGQNPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGMHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCQDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRESEDYESFSCVCPTGWQGQTCEVDINECVVSPCRHGASCQNTHGGYRCHCQAGYSGRNCETDIDDCRPNPCHNGGSCTDSINTAFCDCLPGFQGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVAQLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPQIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPEALLGQVKASLLPGGGGGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNKEETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGSRLAFEAGPPRLSHLPVASGTSTVLGCSSGGAMNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPPNIQQQPNLQPPPPPPQPHLGVSSAASGHLGRSFLGGEPSQADVQPLGPSSLAVHTILPQESPALPTSLPSSLVPPVTAAQFLTPPSQHSYSSSPVDNTPSHQLQVPEHPFLTPSPESPDQWSSSSPHSNVSDWSEGVSSPPTSMQSQIARIPEAFK

SEQ ID NO: 65 - protein, 2421 aa, Gorilla gorilla gorilla
RCPEGLLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGICRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCVDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCQCVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGSGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQVPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 66 - protein, 2272 aa, Canis lupus familiaris
MPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECISNPCQNDATCLDQIGEFQCICMPGYEGVHCEVNTDECASSPCLQNGRCLDKINEFLCECPTGFTGHLCQYDVDECASTPCKNGAKCLDGPNTYSCMCTEGYTGLHCEVDIDECDPDPCHYGVCKDGVATFTCLCQPGYTGHHCESNINECHSQPCRHGGTCQDRDNAYLCSCLKGTTGPNCETNLDDCASSPCESGTCLDRIDGYECACEPGYTGSMCNVNIDECAGNPCHHGGTCEDGINSFMCRCPEGYHGPTCLSEVNECSSNPCIHGACRDSLNGYKCDCDPGWSGANCDVNNNECESNPCANGGACRDMTSGYVCTCREGFSGPNCQTNINECASNPCLNQGSCIDDVAGYKCNCPLPYTGATCEVVLAPCAPSPCRNGGACKESEDYESFSCICPTGWQGQTCEVDINECVKTPCRNGASCQNTNGGYRCHCRAGYTGRNCETDVDDCRPNPCHNGGSCTDGVNTAFCDCLPGFQGPFCEEDINECASNPCRHGANCTDCVDSYTCTCPTGFSGIHCENNTPDCTESSCFNGGTCVDGINSFTCLCPPGFTGSYCQHDINECDSRPCLHGGTCQDSYGTYRCTCPQGYTGLNCQNLVRWCDSSPCKNGGKCWQSNTLYRCECHSGWTGLYCDVPNVSCEVAAQRQDVNVTHLCRNGGLCMDAGNTHHCRCQAGYTGSYCEDQVDECSPSPCQNGATCTDYPGGYSCECVAGYHGVNCSEEMNECLSHPCQNGGTCIDLINTYKCSCPRGTQGVHCEVNVDDCSPPIDPVSRGPKCFNNGTCVDQVGGYSCTCPPGFVGERCEGDVNECLSNPCDIRGTQNCVQRVNDFYCECRAGHTGRRCESIINGCKGRPCQNGGTCAVASNTARGFICKCPAGFEGATCENDARACGSRRCLNGGTCISGPRSPTCLCLGPFTGPECQFPAGSPCVGGNPCYNQGSCEPTTESPFYRCLCPANFNGLLCHILDYSFGGGLGLDIPPPQIEEACELPECHEEAGNKVCSLACNNHACGWDGGDCSLNFNDPWQNCSQSLQCWKYFSNGHCDSQCNSAGCLFDGFDCQRAEGQCNPLYDQYCKDHFGDGHCDQGCNSAECEWDGLDCAEHVPERLAAGALVLVVLTPPAQLRNNSLHFLRELSRLLHTNVVFKRDAHGQPMIFPYYGREEELRKHPIKRAVDSWAVPGALLNRVEAALLPGGAGRRRRELDPMDIRGSIVYLEIDNRQCVQSSSQCFQSATDVAAFLGALASLGSLNIPYKIEAVQSETVELPPPPQLHFMYVAVAAFVLLFFVGCGVLLSRKRRRQHGQLWFPEGFKVSEASKKKRREPLGEDSVGLKPLKNVSDGALMDDNQNEWGDEDLEAKKFRFEEPVVLPDLDDQTDHRQWTQQHLDAADLRVSAMAPTPPQGEADADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVEAAVVLLKNGANKDMQNNKEETPLFLAAREGSYETAKVLLDHFANRDITDHMDRLPRDIAQERMHHDIVRLLDEYSLVRSPQLHGPALGGTPTLSPPLCSPNGYLGNLKPSVPGKKARKPSTKGLACGGKETKDLKARRKKSQDGKACLLDSSSVLSPVDSLESPHGYLSDVASPPLLSSPFQPSPSVPLGHLPGMPDAHLGVSHLSVAAKPEMATLAGGGRLAFEAGPPRLSHLPVASSTGTVLGTGSGSTSGSGGGAVNFTMGGATALNGQCEWLSRLQNGLVPNQYNPLRGNVAPGPLSSQAPGLQHSLMGPLHAGLPTTAALSHMMSYQALPNTRLASQPHLVQTQPLQQVPQQQQNLQMPQPGLQPPPSLQPPTIQQPQSLPPPPQPPQPHLGVSSAASGHVGRSFLGGEPSQADVQPLGASGLAVHTILPQDSQALPTALPAALAPAMTTAQFLTPPSQHSYSSSPADNTPSHQLQVPEHPFLTPSPESPDQWSSSSPHSHVSDWSEGISSPPTSTQSHIAHIPETLK

SEQ ID NO: 67 - protein, 2549 aa, Ciona intestinalis
  misc_feature (1375)..(1375): Xaa can be any naturally occurring amino acid
MGLKVLMFCTLVALLIFSFAGNCKGVSCSLNPCLNGGECITHYDGNDICRCARGYGGATCNVQDTTCDVSHCNNGGTCHTAVEDGRTVQMCLCTFAYTGDTCQVLISSCEEVDCVQGECEIQDGRAVCVCEENYTGPRCNNYDYCSSEPCRNGATCTNLPQHFSCTCAEYWFGDTCENFRSPCISVPNICKNNGVCETTDDHWYCVCPNGFVGNYCEAKNIQRSSDPCTPDPCVNSGTCVEKSATVYQCVCLPGFGGTNCEIDIDDCQDDPCHNGATCIDQANSPLCQCAPGWTGATCEHGVDECALNPSACLHGGTCLNSEGSYQCTCVNGWTGEDCGTNEDNCLNKPCFHGATCIDLVGRFECICPLNKTGLLCHVDNACVADPPPCAAGAQCDTNPINGQAICTCPAGYTGVNCSLDLNECDLGTNPCEYDGTCVNIPGSYKCVCANGYSGPRCEENINECESNPCVNDATCLDKIGTFLCLCLPGYTGVTCSEEIDECESNPCLYDGECIDQVHGYICNCAAGYTGTNCQTNIDDCALAHCQNHIECVDDVDDYTCICLPGYGGRNCETDIDECASSPCHYGTCVDGINRYTCNCELGYGGTLCDTPINECDSNPCQNGGTCHDLVASYSCDCPLGTAGSNCETNIQECASNPCQHGQCVDGINKYTCDCDPGYSGLHCGADINECLSNPCYNGGTCENRLNSFVCHCPAGYNDPRCYSNIDECMSNPCVNGDCQDDINKYICNCYHGYVGVNCEYDINECESSPCVNGGSCLDLVNSYSCRCKTGYEGVNCETDIDECSPSPCLNGGSCANLIGRYVCTCPLGFTGSECETALTPCDPIPCNNGGSCQPNADYLGYTCVCTPGFQGPTCANDINECMSPPCKNGGKCRNREPGYFCECLDGYSGVNCEENVDDCASDPCMNGGTCLDDVNSYKCLCKRGFDGNQCQNDVNECENEPCKNGATCTDYVNSYACTCPPGFRGTTCMENIDECNIGSCLNGGTCVDGINSYSCNCMAGFTGANCERDIDECVSSPCKNGAPCIHGINTFTCQCLTGYTGPTCAQMVDLCQNNPCRNGGQCSQTGTTSKCLCTSSYSGVYCDVPRLSCSAAATWQGVEETSLCQHGGQCINSGSTHYCSCRAGYVGSYCETDEDDCASYPCKNGATCTDYPGSYTCTCMDGFQGTRCETELNECESNPCLNNGQCVDLINAYKCLCQVGTSGDRCQDNENECTSTSCFNSGNCVDGIGGFTCTCVPGYAGPRCEGDVNECVPNPCNTEGSTNCVQGINKFTCTCKQGYTGTRCEKKLTSCSTMPCFNGATCTDAPYEPTGYRCTCSNGYRGTNCEEVMSRCRDGLVCYNGGTCHENASGGEMCXCPADYNGDNCIYYIPGQAAGPGTNNINIPEFIKKVCLDPTCAALKGNGECDAKCNTHGCEYDGGDCSYGNTDPWAKCPASLQCYNYFHDGACDEACNNADCLFDGFDCETPHEACPADYQDYCDKNYKNNKCDSGCNTFGCGWDGLDCDKDHPQQPAAGELIMIVLIPPEELISRQAEFLRFIGTVLHSVVEFKLTTSGQPYIEAISSQLSRKKRSVISSLGWEKFVGYDSSIYHNKTHTRLRRASNTFFSKAHLLVNSQKCKQTSSECIDTTDNAASVISARASTGTLEAEFPINTVASTTNPTPPPQDYTYIVGAAGGVVLVIVIIGVLTHRKRKRETSTLWAPEGFNVTKKQRREPIGQDDLNGLNGSIHPGELTQLDTAGTPFLNRWENTSLPQKSNHYHVQYTPENITFLPNNGTVPRSQMSSSAQKSSSRDDMEPTDNRKWTPQHLEAADLSRAGSACTPVTDLTPPPHIDVDEDDVNARGPDGVTPLMVASIRGGGVDHGISDDESQHSGDAGISGEGSDSMIAGLLLQGASLSAQTDRSGETALHLAARYARADAAKRLLDAGADANMKDHSGRTPLHSAVAADAQGVFQILLRNRATDLDARTNDGTTPMILASRLAVEGMVEELISANADVNAVDDHGKSALHWAAAVNNVDAVSTLLRAGCNRDAQTEREETPLFLAAKEGSYEAIRILLDHYANRDITDHMDRLPRDIAQERLHTDIVQLLDEYNLVRSPPLPANHMTSHMNGHAMMSRDPYLTSQMKQHTTGKKPRRQSNRADGKPSRRVKKTPTSSQGPPSSVTTADSITPVIDPTPNMAIHPGITHVGESTLSPGNNSLPSPATTYSTDSTLSPPSSMGPPSNGTYHPHLHPHQQGVPHQFSNMEERMMSTLNYRGTPPRLSHPLPHGGAPGLYPARSHGHLAGTHTGLGFSLGQIPNGQVPQEWIQRNERIQQQNQQNQQMYNAVISQSGVHHPSQFAAYRALGFPEQQHNRVDSASSDQRRYSEVIYGKGLPIYSLPHTQPQLGYTTIQGVPHQHPVSSAGQTPPVQTGTVIAPHSYTNVLEKYPTPPSAHTMSPSSGSENLSPPGPLPPAPKHLVHDLSYETPSPDSPDPWSSSSPSNSDWSEGIRSPPGPMQGHHHHAPQPQHQRMRVYPPQNTGAAIAGKMGVA

SEQ ID NO: 68 - protein, 2313 aa, Ceratitis capitata
MWLLINNNTFPKSDIFWIKLLTSLLLICGFIGSGKAAGSSCLSVGCKNGGTCITQSNGLSFCNCSSRYVGEYCEHLNPCFTGLLRCQNGGTCQPSWRNDRLGISCMCPLGFTESLCEIRVPNACDSSPCRNGGSCNLKTLEEYTCSCMNGYTGDHCETQNLCATAPCHNGGTCTSVAGGNSFKCICPKGFKGQTCAEDVIECEANPCKHGGTCKNTHGSYQCMCPGGYTGKNCESKYIPCAPSPCQNGGTCRQSSGLMYECKCPPGFRGKHCDENIDDCPGNLCQNGGTCIDGINTYRCTCPPNFTGELCEEDVDECAMRPSVCQNGATCTNTHGNYSCICVNGWEGRDCSDNVDDCVAAACFYGATCIDGVGSFYCRCTPGKTGLLCHLDDACTSNPCHKDAICDTSPINGSYTCSCATGYKGMDCSEDIDECDQGSPCEHNGICVNTPGSFRCNCSQGFTGPRCETNINECESHPCQNEGSCLDDPGTFRCVCMPGFAGTQCEIDIDECQSNPCLNGATCHDMINGFKCSCALGFAGTRCQINIDDCQSQPCRNNGICHDSIAGYTCECPPGYTGASCEININDCDSNPCHRGKCIDGDNSFKCVCDPGFTGYLCQTQINECESNPCQFGGHCIDRVGSYLCKCLPGTSGKNCEINVNECHSNPCNNGATCIDGINKYTCECVPGFTGLHCEININECASNPCANNGVCMDMVNGYKCECPRGFYDARCLSDVDECASNPCINGGRCEDGINEFICHCPPGYGGKRCEIDIDECSSNPCQHGGICIDQLNSFQCQCMPGYTGYRCETNIDDCIMNPCVNGGSCIDLVNGYKCVCKVPFTGRDCESKMDPCSTHRCRNDAKCTPSPNFLDFSCTCKLGYTGRYCDEDIDECALSSPCRNGATCLNVPGTYKCLCAKGYEGRDCAINTDDCASFPCQNGGTCLDGIGDYTCLCVDGFDGKHCETDINECLSLPCQNGATCRQYVNSYTCTCPLGFSGINCQKNDEDCTESSCMNGGTCIDGINSYNCSCLPAFTGSNCQYKINKCDSQPCQNGATCHESGDEYTCHCPHGYTGKQCTEYVDWCSQSPCENGATCSQIKNQYNCKCDAGWTGKLCDVEMVSCEVAAMRKKVGLKQLCNNGTCKEMGNMHLCLCKQGYTGSYCQTDINECESQPCQNGGTCLDRVGEYKCMCPKGFQGQNCELNIDDCSPNPCQNGGTCHDLVQSFSCSCPPGTLGIICEINQEDCVPGACHNNGSCIDRVGGFECACPAGFVGSRCEGDINECLSNPCSNAGTLDCVQLVNDFHCNCKPGYMGRHCEIKVDFCANSPCQNGGICSTKQSGHHCVCQVGFYGKNCEFSGNDCDSNPCQAGNCVVDMMRGYRCECPPGTEGMQCEIDILDECASNPCLQGAACENLLGDFVCFCPSKWPGKRCEIYDANYPGWTSDSSRAPLNKYSKDLEYQREMCIKRGCEQKKGNHKCDQECNTYACNFDGNDCSLGINPWVNCSATIECWRVFMDGHCNEECNNAACLFDGRDCAKKLQPCNPTYEAYCQKHYADGHCDYGCNNAECNWDGLDCENNLEQPNLADGAISVVMLMDIKTFREKQVEFLREMGHMLRTTVRIKKDSMGNDMIFSWKGTSHLTELENSEFGRKHRILSSERNDQTGIQIYLEIDNRKCIDCFNRAAEAAEFLAASAAKYTLSPKFQIYSVRGVQNPGEDVEERPSNVKYVLIGISIVVFAFLGVLVTTQRKRAHGITWFPENFRTTTSTAVNHQRRRRDAGQEMRNLNKNSSIACMSNDVNMNSGHMGHAPQWSDDESELPPQKRMRNEHGGYASDHTMVTDYEEADPRVWSQAHLEVADVRSSIMTPPAHQDGKHDVDVRGPCGMTPLMVAAVRGGGLDSGEDIENSDDQTAQVISDLLAQGAELNATMDKTGETSLHLAARYARADAAKRLLDAGADANCQDNTGRTPLHAAVAADAMGVFQILLRNRATNLNSRMHDGTTPLILAARLAIEGMVEDLITADADINAADNSGKTALHWAAAVNNTEAVNILLMHHANRDAQDDKDETPLFLAAREGSYEACKALLDNFANREITDHMDRLPRDVASERLHHDIVILLDEHVPRSPQMMAMTPQTMISSPPPGNQGQVIAQPTVISSSKQPAPTTKSKAAKKAKLLEGSPDNLLDGGSLRRKPGSKKGAGGSVSKKGGQNGLTAAQLLNGLGGGLTAHGQGLEGVDQQQLLDAGLSAVDSPPLTGLTSQPSPYDTSSMYSNAMAAPTHHHNDLLGNSNGAKQPPSYEDCIKTMQSLVQQQQQQQQ

SEQ ID NO: 69 - protein, 198 aa, Homo sapiens
PGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQI

SEQ ID NO: 70 - protein, 198 aa, Homo sapiens
PGLLGVKKLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQI

SEQ ID NO: 71 - protein, 199 aa, mus musculus
PGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLP

SEQ ID NO: 72 - protein, 199 aa, mus musculus
PGIAGTLSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLP

SEQ ID NO: 73 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCQDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 74 - protein, 430 aa, Rattus norvegicus
HCDGVNLTCEACQEPGGLVVPPTDAPVSSTTPYVEDTPEPPLHNFYCSKLLDLVFLLDGSYRLSEAEFEVLKAFVVGTMERLHISQKRIRVAVVEYHDGSHAYLELRARKRPSELRRIASQIKYVGSQLASTSEVLKYTLFQIFGKIDRPEASRVILLLTASQEPQRMARYFTRYLQGFKKKKVILIPVGIGPHANLKQIRLIEKQAPENKAFLLSGVDELEQRRDEIINYLCDLAPEAPAPSKPPQVAHITVSPGISGVSSPGPKRKSLVLDVVFVLEASDEVGEANFNKSKEFLEEVIQRMDVSPAGTHIAVLQYSYTVNVEYTFKEAQSKEDVLRHVREIRYQGGNRTNTGQALQYLSEHSFSPSQGDREQAPNLVYMVTGNPASDEIRRLPGDIQVVPIGVGSRANLQELERISRPITPIFIQDFE

SEQ ID NO: 75 - protein, 2812 aa, Rattus norvegicus
MNPFGYEICLLVLALTWPGTLCTEDPRDRPSTARCSLFGDGFINTFDEAMYSFAGGCSYLLAGDCQKRSFSILGNFQDGKRVGLSVYLGEFFDIHLFANGTVMQGDQSISMPYASKGLYVEHEAGYYKISSEAFGFAARIDGDGNFQVLMSDRHFNKTCGLCGDFNIFAEDDFRTQEGTLTSDPYDFANSWALSSENQRCKRTSPPSTNCTSSSGDMQQAMWEQCQLLKTASVFARCHPLVDPEPFVALCEKTLCTCVTGPECACPALLEYARTCAQEGMVLYGWADHSACRPACPAGMEYKECVSPCTRTCQSLPINEVCQQQCVDGCGCPEGELLDEDRCVQSSDCSCVHAGKRYPPGTSLPQDCNTCICRHSLWICSNEECPGECLVTGQSHFKSFDNRHFTFSGICQYLLARDCQDHSFSIVIETMQCADDPDAVCTRSVSVRLSALHNSLMKLKHGGGVAIDGQDVQIPFLQGDLRIQHTVMASVRLSYGEDLQMEWDGRGRLLVKLSPIYSGKTCGLCGNYNGNKGDDFLTPAGLVEPLVVDFGNAWKLQGDCPDLHRQHSDPCSLNPRLTRFAEEACALLTSSKFETCHHAVSPLPYLQNCRYDVCSCADSQDCLCSAVANYAAACARKGVHIGWREPDFCALSCPQGQVYLQCGNSCNMTCRSLSLPDEECSEVCLEGCFCPPGLYQDERGDCVPKAQCPCYHDGELFQPADIFSDHHTMCYCEDGFMHCTTSGASGSLLPNIVLSSPLSHRSKRSLSCRPPMVKLVCPADNPRAQGLECAKTCQNYDLECMSLGCVSGCLCPPGMVRHENRCVALERCPCFHQGEAYSPGDTVKIGCNTCVCRDRRWNCTTHVCDATCSALGMAHYLTFDGLKYLFPGECQYVLVQDYCGGSSGTFRILVGNEGCTYPSVKCKKRVTILVDGGEIELFNGEVNVKRPLKDESHFEMVESGQYVILLLGQGLSVVWDHRLSISVVLKYTYQEHVCGLCGNFDGIQNNDFTSSSLQVEEDPIDFGNSWKVSPQCADTRKLSLDVSLAACHNNIMKQTMVDSSCRILTSDIFQGCNRLVDPEPYLDICIYDTCSCESIGDCSCFCDTIAAYAHVCAQHGQVVAWRKPTLCPQSCEERNVRENSYECEWRYNSCAPACPVTCQHPEPLACPVQCVEGCHAHCPPGKILDELLQTCVDAQDCPVCEVAGRRLASGKKITLSPNDPQHCQNCHCDGVNLTCEACQEPGGLVVPPTDAPVSSTTPYVEDTPEPPLHNFYCSKLLDLVFLLDGSYRLSEAEFEVLKAFVVGTMERLHISQKRIRVAVVEYHDGSHAYLELRARKRPSELRRIASQIKYVGSQLASTSEVLKYTLFQIFGKIDRPEASRVILLLTASQEPQRMARYFTRYLQGFKKKKVILIPVGIGPHANLKQIRLIEKQAPENKAFLLSGVDELEQRRDEIINYLCDLAPEAPAPTKPPQVAHITVSPGISGVSSPGPKRKSLVLDVVFVLEASDEVGEANFNKSKEFLEEVIQRMDVSPAGTHIAVLQYSYTVNVEYTFKEAQSKEDVLRHVREIRYQGGNRTNTGQALQYLSEHSFSPSQGDREQAPNLVYMVTGNPASDEIRRLPGDIQVVPIGVGSRANLQELERISRPIAPIFIQDFETLPREAPDLVLRTCCSKEGLQLPTLPPLPDCSQPLDVVLLLDGSSSLPASSFDEMKSFAKAFISKANIGPHLTQVSVIQYGSINTIDVPWNVAQEKAYLQSLVDLMQQEGGPSQIGNALAFAVRYVTSQIHGARPGASKAVVMIIMDTSLDSVDTAVDAARSNRVAVFPIGVGDRYDEAQLRILAGPGASSNVVKLQQVEDLLTMVTPGNSFFHRLCSGFSGVCVDEDGNEKRPGDVWTLPDQCHTVTCLANGQTLLQSHRVNCDHGPRPSCSNSQSPVRVEETCGCRWTCPCVCTGSSTRHIVTFDGQNFKLTGNCSYVIFQNKEQDLEVVLHNGACSPGAVQTCMKTIEVKHAGLSVELRSDMEMAVNGRPVLAPYVGGNMQVSIYGAIMYEVRFTHLGHTLTFTPQNNEFQLQLSPKTFASKMYGLCGICDENGANDFTLRDGTVTTDWKRLIQEWTVQQPGSTCQSVPEEQCPISDSSHCQVLLSASFAECHKVIAPATFHTICQQDSCHQERVCEVIASYAHLCRTNGVCVDWRTTDFCAMSCPPSLIYNHCERGCPRYCDGNTSFCGDHPSEGCFCPQHQVLLEGSCVPEEACTQCVGDDGVRHQFLETWVPDHQPCQICMCLSGRKINCTAQPCPTARAPTCGPCEVARLKQSADLCCPEYECVCDLVNCNLPPVPPCEGGLQPTLTNPGECRPTFTCACRKEECKRVSPPSCPPHRTPTLRKTQCCDEYECTCSCVNSTLSCPLGYLASATTNDCGCTTTTCLPDKVCVHRGTVYPVGQFWEEGCDTCTCTDMEDTVVGLRVAQCSQKPCEDSCQPGFSYVLHEGECCGKCLPSACKVAGSPRGDSLSSWKSVGSQWAVPENPCLINECVRVEDAVFVQQRNISCPQLAVPTCPTGFQLNCETSACCPSCHCEPVEACLLNGTIIGPGKSVMVDLCTTCRCIVQRGAIFRFKLECRKTTCEACPVGYREEKSQSECCGRCLPTACTIQLRGGRVMTLKQDETFQDGCDSHLCRVNERGEYIWEKRVTGCPPFDERKCLAEGGKIVKIPGTCCDTCEEPDCKDITAKVQYIKVGDCKSEEEVDIHYCQGKCASKAVYSIDIEDLQEQCSCCWPSSTERMRVPLLCTNGSVVHHEVINAMQCRCSPRNCGK

SEQ ID NO: 76 - protein, 2813 aa, Pan troglodytes
MIPARFARVLLALALILPGTLCAEGTRGRSSMARCSLFGNDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPAFLEYARTCAQEGMVLYGWTDHSACSPVCPAGMEYKQCVSPCARTCQSLHINEMCQERCVDGCSCPEGQLLDEGLCVESTECPCVHSGKRYPPGASLSRDCNTCICRNSQWICSNEECPGECLVTGQSHFKSFDNRYFTFSGICQYLLARDCQDHSFSIVIETVQCADDRDAVCTRSVTVRLRGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVSVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLQAEGLECAKTCQNYDLECMSMGCVSGCLCPPGMVRHGNRCVALERCPCFHQGKEYAPGETVKIGCNTCVCRDRKWNCTDHVCDATCSMIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPKDCPVCEVAGRRFASGKKVTLNPSDPEHCQICHCDGVNLTCEACQEPGGLVVPPTDGPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSGVDELEQQRDEIVSYLCDLAPEAPPPTLPPHVAQVTVGLGLLGLSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALQYLSDHSFLVSQGDREQAPNLVYMVTGNPASDEIKRLPGDIQVVPIGVGPNANVQELERIGWPNAPILIQDFESLPREAPDLVLQRCCSGEGLQIPTLSPASDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPNSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDVVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLNCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 77 - protein, 937 aa, Bos taurus
MFPTRLARLLLAVALTLPGALCGEGALGKSSMARCSLFGADFINTFDESMYSFSGDCSYLLAGDCKTHSFSIVGDFQGGRRMGLSVYLGEFFDIHVFVNGTVLQGGQHVSMPYATRGLYLETEVGHHKLSSESYGFVARIDGSGNFQILLSDRHFNKTCGLCGDFNIFAEDDFRTQEGTLTSDPYDFANSWALSSEEQRCPRVSPPSSSCNVSSELQKGLWEKCQLLKTASVFARCHALVDPEPFVALCERMLCACAQGLRCPCPVLLEYARACAKQGMLLYGWADHSSCRPDCPTGMEYKECVSPCHRTCRSLSITEVCREQCVDGCSCPEGQLLDEGRCVESTECPCVHAGKPYPPGASLSRDCNTCICRNSQWVCSNEDCPGECLITGQSHFKSFDDRHFTFSGVCQYLLAQDCQDHSFSVVIETVQCADDPDAVCTRSVTVRLPSPHHGLLKLKHGGGVALDGQDVQIPLLQGDLRIQHTVTASLQLNFGEDLQIDWDGRGRLLLKLSPVYAGRTCGLCGNYNGNQRDDFLTPAGLVEPLVEHFGNSWKLRADCEDLQEQPSDPCSLNPRLTKFADQACAILTSPKFEACHSAVSPLPYLRNCRYDVCACSDGRDCLCDAVANYAAACARRGVHVGWREPSFCALSCPHGQVYQQCGTPCNLTCRSLSHPDEECTEVCLEGCFCPPGLFLDETGSCVPKAQCPCYYDGEIFQPEDIFSDHHTMCYCEDGFMHSATSGAPGSLLPEAVLSSPLSHRSKRSLSCRPPMVKVVCPADNPRAEGLECTKTCQNYDLECMSTGCVSGCLPAPGMVRHENRCVALERCPCFHQGREYAPGDRVKVDCNSCVCQDRKWNCTDHVCDASCSALGLAHYFTFDGLKYLFPGECQYVLVQDHCGSNPGTFRVLVGNEGCSVPSLKCRKRITILVEGGEIELFD

SEQ ID NO: 78 - protein, 2809 aa, Bos taurus
MFPTRLARLLLAVALTLPGALCGEGALGKSSMARCSLFGADFINTFDESMYSFSGDCSYLLAGDCKTHSFSIVGDFQGGRRMGLSVYLGEFFDIHVFVNGTVLQGGQHVSMPYATRGLYLETEVGHHKLSSESYGFVARIDGSGNFQILLSDRHFNKTCGLCGDFNIFAEDDFRTQGTLTSDPYDFANSWALSSEEQRCPRVSPPSSSCNVSSELQKGLWEKCQLLKTASVFARCHALVDPEPFVALCERMLCACAQGLRCPCPVLLEYARACAKQGMLLYGWADHSSCRPDCPAGMEYKECVSPCHRTCRSLSITEVCREQCVDGCSCPEGQLLDEGRCVESTECPCVHAGKPYPPGASLSRDCNTCICRNSQWVCSNEDCPGECLITGQSHFKSFDDRHFTFSGVCQYLLAQDCQDHSFSVVIETVQCADDPDAVCTRSVTVRLPSPHHGLLKLKHGGGVALDGQDIQIPLLQGDLRIQHTVTASLQLNFGEDLQIDWDGRGRLLLKLSPVYAGRTCGLCGNYNGNQRDDFLTPAGLVEPLVEHFGNSWKLRADCEDLQEQPSDPCSLNPRLTKFADQACAILTSPKFEACHSAVSPLPYLRNCRYDVCACSDGRDCLCDAVANYAAACARRGVHVGWREPSFCALSCTHGQVYQQCGTPCNLTCRSLSHPDEECTEVCLEGCFCPPGLFLDETGSCVPKAQCPCYYDGEIFQPEDIFSDHHTMCYCEDGFMHCSTSGAPGSLLPEAVLSSPLSHRSKRSLSCRPPMVKVVCPADNPRAEGLECTKTCQNYDLECMSTGCVSGCLCPPGMVRHENRCVALERCPCFHQGREYAPGDRVKVDCNSCVCQDRKWNCTDHVCDASCSALGLAHYFTFDGLKYLFPGECQYVLVQDHCGSNPGTFRVLVGNEGCSVPSLKCRKRITILVEGGEIELFDGEVNVKTPMKDETHFEVVESGRYITVLLGKALSVVWDGHLAVSVFLKRTYQERVCGLCGNFDGVQNNDLTSSSLQVEENPVDFGNSWKVSPQCADTQKVRLDSAPAICHDNVMKQTMVDSSCRVLTSDVFRECNRLVNPEPYLDVCIYDSCSCESIGDCSCFCDTIAAYAHECAQHGQVVTWRTATLCPQNCEERNLKESGYQCEWRYNSCAPACPVTCQHPEPLACPVQCVEGCHAHCPPGKILDELLQTCVNPEDCPVCQVEGRRLASGKKVTLNPGDPEHCQICHCDGVSLTCEACKEPGGPPPTEGPVIPTTPYVEDIPEPPLHDFFCSKLLDLVFLLDGSSKLSEADFETLKAFVVGMMERLHISQKRIRVAVVEYHDGSHAYLALQDRKRPSELRRIAGQVKYAGSEVASTSEVLKYTLFQIFGRIDRPEASRVALLLTASQEPPRLARNLVRYVQGLKKKKVSVVPVGIGPHASLKQIRLIEKQAPENKAFVLSGVHELEQRMDDIVGYLCDLALEVPAPTLTQHPLAAQVTVAPQLLGPSLPGPKRSSVVLDVAFLLEGSDEVGEANFNRSAEFVEEVIRRMDVGQDGIHVTVLQYSYVVTVEHSFREPQSKDVVLQRLREVRYRGGNQTNTGLALQYLSEHSFSASQGDREQAPNLVYMVTGSPASDKIQRMPGDIQLVPIGVGPRVDVQELERVSWPQTPIFIQDFERLPREAPDLVLQRCCSEDGPHLPTLAPAPDCSQPLDVVLLLDGSSTSPASYFDEMKSFAKAFISKANLGPQLTQVSVLQYGSNTNVDVPWDIHVDKAHLLSLVDPMHREGGPSQVGNALSFAARYITSQVHGARPSASKVVVILVTGSSMDSVEAAAAAARSNRVAVFPIGIGDQYDAAQLRVLAGPGASSNVAELQRIEDLPSMVALGNSFFQRLCSGFVSVCVDEDGNERRPGDVWTLLDQCHTVTCLPDGQTLLKSHRVNCDQGPQPSCPDGQTPLRMEEACGCRWACPCVCTGSSTRHIVTFDGRNFKLTGNCSYVLFHNKEQDLEVILHNGFCSAGARQACMKSVEVKQNGLSVELRSNMEVMVNGRLVSVPYLGGDMEVRVYGTIMFEVRFMGHILSFTPQNNEFQLQLRPKIFASKTYGLCGFCDENGANDFMLRDGTVTEDWKTLVREWTVQQPGQTCPLGPEEPCPISQGSRCQVLLSELFAECHKVLAPATFHAMCQQDSCQQEQVCEAIASYAHLCRTKGVCVDWRTPDFCAVSCPPSLIYNHCESGCPRQCEGNSSSCGDHPLEGCFCPPHQVMLEGSCVPEEACTQCVGDDGIRHQLLETWVPDHQPCQICTCLSGRKVNCTTQPCPSAGVPTCGPCEVARLRQSTQQCCPEYECVCDLVSCDVPPVPNCEDGLQPVLANPGECRPSFTCVCRKEECPKGSPPSCPPHRMPALRKTRCCDEYECACNCTNSTVSCPLGYLASTITNDCSCTTTTCLPDKVCVHRGTIYPVGQFWEEGCDTCTCTDLEDAVMGLRVAQCSQKPCADICRPGFTYVLREGECCGRCLPSACEVVTGSPRGDSQTQWKSVGSHWASPENPCLIHECVRVEEEVFVQQRNVSCPQLNVPVCPLGFQLRCQTLGCCPTCRCEPVQACVLNGTIIGPGKTVMVDACMTCRCHVQAGVISGFKLECRKTTCQACPAGYMEEKLQGECCGRCLPTACTIQLRGGQIMMLKRDETLQDGCDSHFCKVNKRGEFIWEKRVMSCPPFNEHKCLAEGGEIMKIPGTCCDTCEEPECKDITARVKSIKVGDCKSEDEVDIHYCQGRCTSKALYSIDTEDVQDQCSCCSPTRTEPMPVPLRCTNGSIIHHVVLNALQCQCSSRKCSP

SEQ ID NO: 79 - protein, 2813 aa, Canis lupus familiaris
MSPTRLVRVLLALALILPGKLCTKGTVGRSSMARCSLFGGDFINTFDESMYSFAGDCSYLLAGDCQEHSVSLIGGFQNGKRVSLSVYLGEFFDIHLFVNGTMLQGTQSISMPYASNGLYLEAEAGYYKLSSEAYGFVARIDGNGNFQVLLSDRYFNKTCGLCGNFNIFAEDDFRTQEGTLTSDPYDFANSWALSSGEQRCKRVSPPSSPCNVSSDEVQQVLWEQCQLLKSASVFARCHPLVDPEPFVALCERTLCTCVQGMECPCAVLLEYARACAQQGIVLYGWTDHSVCRPACPAGMEYKECVSPCTRTCQSLHVKEVCQEQCVDGCSCPEGQLLDEGHCVGSAECSCVHAGQRYPPGASLLQDCHTCICRNSLWICSNEECPGECLVTGQSHFKSFDNRYFTFSGVCHYLLAQDCQDHTFSVVIETVQCADDLDAVCTRSVTVRLPGHHNSLVKLKHGGGVSMDGQDIQIPLLQGDLRIQHTVMASVRLSYGEDLQMDWDGRGRLLVTLSPAYAGKTCGLCGNYNGNRGDDFVTPAGLAEPLVEDFGNAWKLLGACENLQKQHRDPCSLNPRQARFAEEACALLTSSKFEPCHRAVGPQPYVQNCRYDVCSCSDGRDCLCSAVANYAAACARRGVHIAWREPGFCALSCPQGQVYLQCGTPCNMTCRSLSYPEEDCNEVCLEGCFCPPGLYLDERGDCVPKAQCPCYYDGEIFQPEDIFSDHHTMCYCEDGFMHCTTSGGLGSLLPNPVLSSPRSHRSKRSLSCRPPMVKLVCPADNPRAEGLECAKTCQNYDLQCMSTGCVSGCLCPQGMVRHENRCVALERCPCFHQGQEYAPGETVKIDCNTCVCRDRKWNCTDHVCDATCSAIGMAHYLTFDGLKYLFPGECQYVLVQDYCGSNPGTFRILVGNEGCSYPSVKCKKRVTILVEGGEIELFDGEVNVKKPMKDETHFEVVESGQYVILLLGKALSVVWDHRLSISVTLKRTYQEQVCGLCGNFDGIQNNDFTSSSLQIEEDPVDFGNSWKVNPQCADTKKVPLDSSPAVCHNNIMKQTMVDSSCRILTSDIFQDCNRLVDPEPFLDICIYDTCSCESIGDCTCFCDTIAAYAHVCAQHGKVVAWRTATFCPQNCEERNLHENGYECEWRYNSCAPACPITCQHPEPLACPVQCVEGCHAHCPPGKILDELLQTCIDPEDCPVCEVAGRRLAPGKKIILNPSDPEHCQICHCDGVNFTCQACREPGSLVVPPTEGPIGSTTSYVEDTPEPPLHDFHCSRLLDLVFLLDGSSKLSEDEFEVLKVFVVGMMEHLHISQKRIRVAVVEYHDGSHAYIELKDRKRPSELRRITSQVKYAGSEVASTSEVLKYTLFQIFGKIDRPEASRIALLLMASQEPSRLARNLVRYVQGLKKKKVIVIPVGIGPHASLKQIHLIEKQAPENKAFVFSGVDELEQRRDEIINYLCDLAPEAPAPTQHPPMAQVTVGSELLGVSSPGPKRNSMVLDVVFVLEGSDKIGEANFNKSREFMEEVIQRMDVGQDRIHVTVLQYSYMVTVEYTFSEAQSKGEVLQQVRDIRYRGGNRTNTGLALQYLSEHSFSVSQGDREQVPNLVYMVTGNPASDEIKRMPGDIQVVPIGVGPHANVQELEKIGWPNAPILIHDFEMLPREAPDLVLQRCCSGEGLQIPTLSPTPDCSQPLDVVLLLDGSSSIPASYFDEMKSFTKAFISRANIGPRLTQVSVLQYGSITTIDVPWNVAYEKVHLLSLVDLMQQEGGPSQIGDALSFAVRYVTSEVHGARPGASKAVVILVTDVSVDSVDAAAEAARSNRVTVFPIGIGDRYSEAQLSSLAGPKAGSNMVRLQRIEDLPTVATLGNSFFHKLCSGFDRVCVDEDGNEKRPGDVWTLPDQCHTVTCLPDGQTLLKSHRVNCDRGPRPSCPNGQPPLRVEETCGCRWTCPCVCMGSSTRHIVTFDGQNFKLTGSCSYVLFQNKEQDLEVILHNGACSPGAKETCMKSIEVKHDGLSVELHSDMQMTVNGRLVSIPYVGGDMEVNVYGTIMYEVRFNHLGHIFTFTPQNNEFQLQLSPRTFASKTYGLCGICDENGANDFILRDGTVTTDWKALIQEWTVQQLGKTCQPVPEEQCPVSSSSHCQVLLSELFAECHKVLAPATFYAMCQPDSCHPKKVCEAIALYAHLCRTKGVCVDWRRANFCAMSCPPSLVYNHCEHGCPRLCEGNTSSCGDQPSEGCFCPPNQVMLEGSCVPEEACTQCISEDGVRHQFLETWVPAHQPCQICTCLSGRKVNCTLQPCPTARAPTCGPCEVARLRQNAEQCCPEYECVCDLVSCDLPPVPPCEDGLQMTLTNPGECRPNFTCACRKDECRRESPPSCPPHRTLALRKTQCCDEYECACNCVNSTVSCPLGYLASAVTNDCGCTTTTCFPDKVCVHRGTIYPVGQFWEEACDVCTCTDLEDSVMGLRVAQCSQKPCEDNCLSGFTYVLHEGECCGRCLPSACEVVIGSPRGDAQSHWKNVGSHWASPDNPCLINECVRVKEEVFVQQRNVSCPQLNVPTCPTGFQLSCKTSECCPTCHCEPLEACLLNGTIIGPGKSLMIDVCTTCRCTVQVGVISGFKLECRKTTCEACPLGYKEEKNQGECCGRCLPIACTIQLRGGQIMTLKRDETIQDGCDSHFCKVNERGEYIWEKRVTGCPPFDEHKCLAEGGKIMKIPGTCCDTCEEPECKDIIAKLQRVKVGDCKSEEEVDIHYCEGKCASKAVYSIHMEDVQDQCSCCSPTQTEPMQVPLRCTNGSLIYHEILNAMQCRCSPRKCSK

SEQ ID NO: 80 - protein, 2813 aa, Canis lupus familiaris
MSPTRLVRVLLALALILPGKLCTKGTVGRSSMARCSLFGGDFINTFDESMYSFAGDCSYLLAGDCQEHSVSLIGGFQNGKRVSLSVYLGEFFDIHLFVNGTMLQGTQSISMPYASNGLYLEAEAGYYKLSSEAYGFVARIDGNGNFQVLLSDRYFNKTCGLCGNFNIFAEDDFRTQEGTLTSDPYDFANSWALSSGEQRCKRVSPPSSPCNVSSDEVQQVLWEQCQLLKSASVFARCHPLVDPEPFVALCERTLCTCVQGMECPCGVLLEYARACAQQGVVLYGWTDHSVCRPACPAGMEYKECVSPCTRTCQSLHVKEVCQEQCVDGCSCPEGQLLDEGHCVGSAECSCVHAGQRYPPGASLLQDCHTCICRNSLWICSNEECPGECLVTGQSHFKSFDNRYFTFSGICQYLLAQDCQDHTFSVVIETVQCADDLDAVCTRSVTVRLPGHHNSLVKLKHGGGVSMDGQDIQIPLLQGDLRIQHTVMASVRLSYGEDLQMDWDGRGRLLVTLSPAYAGKTCGLCGNYNGNRGDDFVTPAGLAEPLVEDFGNAWKLLGACENLQKQHRDPCSLNPRQARFAEEACALLTSSKFEPCHRAVGPQPYVQNCRYDVCSCSDGRDCLCSAVANYAAACARRGVHIAWREPGFCALSCPQGQVYLQCGTPCNMTCRSLSYPEEDCNEVCLEGCFCPPGLYLDERGDCVPKAQCPCYYDGEIFQPEDIFSDHHTMCYCEDGFMHCTTSGGLGSLLPNPVLSSPRSHRSKRSLSCRPPMVKLVCPADNPRAEGLECAKTCQNYDLQCMSTGCVSGCLCPQGMVRHENRCVALERCPCFHQGQEYAPGETVKIDCNTCVCRDRKWNCTDHVCDATCSAIGMAHYLTFDGLKYLFPGECQYVLVQDYCGSNPGTFRILVGNEGCSYPSVKCKKRVTILVEGGEIELFDGEVNVKKPMKDETHFEVVESGQYVILLLGKALSVVWDHRLSISVTLKRTYQEQVCGLCGNFDGIQNNDFTSSSLQIEEDPVDLGNSWKVNPQCADTKKVPLDSSPAVCHNNIMKQTMVDSSCRILTSDIFQDCNRLVDPEPFLDICIYDTCSCESIGDCTCFCDTIAAYAHVCAQHGKVVAWRTATFCPQNCEERNLHENGYECEWRYNSCAPACPITCQHPEPLACPVQCVEGCHAHCPPGKILDELLQTCIDPEDCPVCEVAGRRLAPGKKIILNPSDPEHCQICHCDGVNFTCQACREPGSLVVPPTEGPIGSTTSYVEDTPEPPLHDFHCSRLLDLVFLLDGSSKLSEDEFEVLKVFVVGMMEHLHISQKRIRVAVVEYHDGSHAYIELKDRKRPSELRRITSQVKYAGSEVASTSEVLKYTLFQIFGKIDRPEASRIALLLMASQEPSRLARNLVRYVQGLKKKKVIVIPVGIGPHASLKQIHLIEKQAPENKAFVFSGVDELEQRRDEIINYLCDLAPEAPAPTQHPPMAQVTVGSELLGVSSPGPKRNSMVLDVVFVLEGSDKIGEANFNKSREFMEEVIQRMDVGQDRIHVTVLQYSYMVTVEYTFSEAQSKGEVLQQVRDIRYRGGNRTNTGLALQYLSEHSFSVSQGDREQVPNLVYMVTGNPASDEIKRMPGDIQVVPIGVGPHANVQELEKIGWPNAPILIHDFEMLPREAPDLVLQRCCSGEGLQIPTLSPTPDCSQPLDVVLLLDGSSSIPASYFDEMKSFTKAFISRANIGPRLTQVSVLQYGSITTIDVPWNVAYEKVHLLSLVDLMQQEGGPSQIGDALSFAVRYVTSEVHGARPGASKAVVILVTDVSVDSVDAAAEAARSNRVTVFPIGIGDRYSEAQLSSLAGPKAGSNMVRLQRIEDLPTVATLGNSFFHKLCSGFDRVCVDEDGNEKRPGDVWTLPDQCHTVTCLPDGQTLLKSHRVNCDRGPRPSCPNGQPPLRVEETCGCRWTCPCVCMGSSTRHIVTFDGQNFKLTGSCSYVLFQNKEQDLEVILHNGACSPGAKETCMKSIEVKHDGLSVELHSDMQMTVNGRLVSIPYVGGDMEVNVYGTIMYEVRFNHLGHIFTFTPQNNEFQLQLSPRTFASKTYGLCGICDENGANDFILRDGTVTTDWKALIQEWTVQQLGKTCQPVPEEQCPVSSSSHCQVLLSELFAECHKVLAPATFYAMCQPDSCHPKKVCEAIALYAHLCRTKGVCVDWRRANFCAMSCPPSLVYNHCEHGCPRLCEGNTSSCGDQPSEGCFCPPNQVMLEGSCVPEEACTQCISEDGVRHQFLETWVPAHQPCQICTCLSGRKVNCTLQPCPTARAPTCGPCEVARLRQNAEQCCPEYECVCDLVSCDLPPVPPCEDGLQMTLTNPGECRPNFTCACRKDECRRESPPSCPPHRTPALRKTQCCDEYECACNCVNSTVSCLLGYLASAVTNDCGCTTTTCFPDKVCVHRGTIYPVGQFWEEACDVCTCTDLEDSVMGLRVAQCSQKPCEDNCLSGFTYVLHEGECCGRCLPSACEVVIGSPRGDAQSHWKNVGSHWASPDNPCLINECVRVKEEVFVQQRNVSCPQLNVPTCPTGFQLSCKTSECCPTCHCEPLEACLLNGTIIGPGKSLMIDVCTTCRCTVQVGVISGFKLECRKTTCEACPLGYKEEKNQGECCGRCLPIACTIQLRGGQIMTLKRDETIQDGCDSHFCKVNERGEYIWEKRVTGCPPFDEHKCLAEGGKIMKIPGTCCDTCEEPECKDIIAKLQRVKVGDCKSEEEVDIHYCEGKCASKAVYSIHMEDVQDQCSCCSPTQTEPMQVPLRCTNGSLIYHEILNAMQCRCSPRKCSK

SEQ ID NO: 81 - protein, 2800 aa, Gallus gallus
MLLLAVLTELLLVTVATGSSGSLLQESSVSRCSLFGKDHIKTFDGSFYSFAGDCSYLLAGDCHKHSFTLLGNYKDGEKTGFSVYLGEYFNLHFLLGGSVMQEDKRVSIPFASNGIFIEKEAGYYKISSNDYGFVVKIDISGNIQIFLQEKYYNKTCGLCGNFNKFAEDDFRTQEGTLVGNSYDFANSWALRSENKLCKRVQTPSSMCNVSSDIAEENVMETCELLRTSLTFARCHHLVDPEPYIHLCKKDICSCTYGMNCHCLAFLEYARNCAHEGVILDGWSQESSCKPRCPVGMEYKACISPCAKTCQSLNINEVCHGQCIDGCSCPEGKLLDGERCVESSDCSCIHSGRHYPPGFTIFQDCNSCICRHGIWICSNGECPGECSITGQSHFKSFDNKHFTFSGICQYLFAKDCVENSFSVIIETVQCADDPDAVCTRSASVRIQDMENSLIKMKHGGGISLNGQDIQTPLLHGILRIQRLVGTLVRLTYGEDLQIDWDGRGGLLVKVSLAYTERMCGLCGNYNGNQGDDFLTPSGLVEVLLEDFGNSWKLNADCQDLLKQDNDPCNLNPHLAKYAEESCSVLISSVFERCHHEVSPTPYVKNCHFDVCSCSSGKDCLCSSIANYATACAMKNVVVQWRAPDFCSMTCPEGQIYQQCGTLCNQTCRSLSYPDENCDEFCMEGCYCPPGHYLDESEKCVPKSQCSCYYDGEIFQPEDIFSDHYTMCYCEDGFMHCSKSKAPGALLPDVFTDEKPSARIKRSLTCRSPMVTLICPENNPRAEGLECAKTCQNFDLECISHGCISGCLCPKGMVRHENKCVAPERCPCFHNGREYAKGETVTKDCNTCVCRGRKWECTKNICDGTCTVIGTAHYLTFDGMKYKFPGECQYVLVQDFCKNNSGTFRILISNEGCSFTGEKCSKRVIILYKSGEIELLNGNVNIKVFPKDSGDLEVMKSGRYYIILLSKSITVTWDLAMGVSVILKADFNDRVCGLCGNFDGIQNNDLTSSNEHLEVDPVDFGNSWKVNTYCADVEKFNWEQALVSPLCNDNILKQVMVETSCSILSGGLFEECKKLVNPEPYIDICMYDTCACESIGDCACFCDAIAAYAHVCAQKGVIVHWRSPDLCPQSCENLNKQELDYQCEWRYNSCGPACPITCQHTQPLKCPLQCVEGCHVHCPAGKILDELSLDCVRPEDCPVCAVGGVKIPHGRRIVLSRDDPQHCQSCLCEGKNLSCVSCEPVEEVLTLTTPAPEEDREFAPSEYSCSKMMDLAFLVDGSNKLSEEDFEQLKTFIAGMMKKLHISQKKIRVSILVYRAGPTIYLGLKDIKTQSQMKKIVQSIKYTGDAVASVAEVLKYIVFQVFGKAERTNAAQIAMLFIASKSPGKVRTIIPALKNKKITLIPVGIGPYVNVEQIRFIEKQLHSRAFQMNNVLELMDNRDLLIDYLCDLGPAESSPEPTPTMSNDIFPQWVLTVPPHFSENPTPKSLDIAFVVEGSDNVGQENFSIIKKFLEKVLTEMNIGQENIHVTLMQYSDTITLEYSFREIQSKESIIEKVRSIPYQGGKATNTGHALDYISKHTFTSANGGRQNVPHLVYMVSSNPSTDVIIRHPTSINVIPIGITPRANVQELRMISQPNRPIILQSYSTLIEEAPELVLQSCCSHKTWTEIPELCNKPMDIMFLLDGSPSIGASEFEEMKNFVRAFIESADISNTSVHVSVLQYARENNLEISLNKPQETEKLIEMVHSIQQREQGPTRLGKAIDFVVQNALSESYGGRPDASKVVIVIVSGKSEDTVETAALTARMNKVSLFPIGVGNGYDEQQLRTLTGPSAVNRIMKLQNFEDLSTMVTLNSEFINKVCMDPVRKCIDEDGNKKKPGDKWTLPDQCHTVTCFPGDYTVLESHQINCERMPKPVCHSNLPAVKVEETCGCRWMCPCVCMGSSSRHIVTFDGLNFKLTSNCSYTLFQDIKHDVEVLLHEGPCKAIPKMNCMDAIEVKHRGVSIQLFSNMTVSVDGESIHIPYSSSLFEVTVYGAIMHEIKFSHLRHNLTFTPRNNEFILKLNPKSFSSETQGLCGVCDQNHANDFMLRDGTVTANSDAFIQDWTVKELGKVCEIRREDECSEHASSHCHLLLSDQFSACHRIIPPDMFYEACEESSCYEEETCEMITSYAHICRENGICIDWRTPEFCPMKCPTYLIYDHCYKACVKICENSTNLSVCKDYPTEGCFCPKGQVVFNDSCVGEEVCTQCISEDGTYHQHMETWIPSNEPCKICTCLDNRKVNCTVRPCTTIKTVQCGPCEVPRLRRDPNQCCPVYECVCDLVSCDLPPVPDCEFGLQLALTNPGECRPNYTCACNREACSLVQRPFCPPHRELTVKKTECCDKYECTCSCSNSTVSCPLGYLSRSLTNDCGCISTTCVPDMVCVHNNIVYPIGKTWKNGCKECSCTSMRDDITGFQMMECHDKICNTFCSRGYKYIVQDGECCGRCQKTACEEQPFWSRGDADPHLYEVGTEWRSPFNRCIINECVRVNDEVFVQQKNLSCSQMDVPDCPDGTELRCDQVIDCCPSCRCVPVNGCPLNGTLIGPWKRMMVDQCTTCICSLQSVSSRRYSLTCTKFSCEPCPTNYRRQEISGSCCGKCVPTSCGIRLRDGRFQYLQPNESLQDGCDSHFCKINEKGEFIWERRITGCPPFDPRRCLAEGGRIAKLGNTCCDTCVEEECRPVSTRLQYKNVNGCVGEKEVPISHCEGKCRSNTRYSIQTEKWEDTCSCCTAIRTTTVAIPLQCPNGTVVQHYIPSASQCECSLRKCTE

SEQ ID NO: 82 - protein, 2800 aa, Gallus gallus; identical to SEQ ID NO: 81

SEQ ID NO: 83 - protein, 2812 aa, Danio rerio
MEACKWSRIMWIVILNLSDLLLVEGSARCSLFSRQHIHTFDGVIYEFPGDCSYMLAGDCRQRSFSILGDFSHGKRKGVTVFLGEMFELHLSVDGTLSQGAERLPLPYASSSVFAGYELGYVRLWSEEFGFSIRIDPLHNIQLTLEKRHSNQTCGLCGNYNYLAEDEYSAQEGFLTDDPYDFANSWAMKGADEPCKRVLPPSQSCNSTGESTKDQMSACESMRSSVLFMHCAHLVDPAAFVSVCESDVCHCSAGKECVCQAMLEYSRACASRGITLSNWHTQSQCSPKCPVGMEYSDCTPTCSTSCQNVNIQEVCKEECVDGCICPAGKVLDGDRCVDVSQCSCTHAGRRYPPASYISQDCNTCVCRHGSWECTNEGCPGECLVTGQSHYKTFDNKFFTFSGICHYLLAKDCQSNSFSAVIETAQCADDQDAICTRSITLRFKDLANQTVHLKHGGVVSVDGMDVQTPLINGPLRIQNTVLSSVRLRYGHDLHLDWDGRGRVLLRLKPAYAGQMCGLCGNYNGNQGDDFLTVGGLVETRVEAFGNSWKMNADCDDVQMQNSDPCSLNPKRVRFAEEACAVLLSMKFEPCHYMVNPEPYVKNCRYDVCACADGQECLCDAVSSYAVACAARGVLVNWRSHGYCELTCPDAQVYEMCGSVCNQTCRSLSLPDTGCDGVCEEGCFCPRGLFLSDAGECVPPQHCSCHHNGEIFEPNDMIGDHHSICVCESGSMHCTSNEATGSTLSDLFFDEQSPSRGRRSLSCPPPLQRFECESARDAGIECAKTCQNLELDCVSLGCVSGCMCPPGTVRYRKDCIPQEQCPCYHNSRPYESGQSITVDCNTCVCEQRQWKCSERVCDGVCRAIGDTHYISFDGLKFSFPGPCQYVLAQDYCNGLDGTFRVLVENSACGIAGYRCSKSITVLYMGGLIVMEHGEVRMKRPVLKETEVEIVRSGLYYIVLLGKHISITWDTGTRISLQISGQYRGKVCGLCGNFDGSQNNDLLSSSNQMEVDAADFGNSWKVRPSCADAVSVVSQCSTDLVKLVTVEQSCRVLTSAIFRDCNSVVDPEPYWDICTQDTCSCPSVGDCACFCNTIAAYAHECAQKGLPVNWRSNDLCPLSCEDLNKESGVQCEWRYNTCASACPSTCQHPEPLSCPISCVEGCHAVCPPGHLLDEVLRKCVEPSQCQVCVHDGQRVSHGKQFILNHEDPRLCQICHCESNTLTCGPCPVTGLTSTLAPTTVTPTPLPFSTPVPADACDRAMDLAFLVDGSSALSEDDFSMIKLFILRVVERFRMGSAHTRATVLLFHSGVKSYDMQVQKWIFKKMVREMRYTGGDVAFMDEAIKYLAVYIYDKNKREHAGRVAILLTASANPRPMRSTQRLLRKKDITILTVALGPDVNMAQVNEITKATPSSRAYVVSSVTELDDEALSITDYLCTLGLDPEPQKKPPTAKPSTTSVTPTTNAITKLTIPPTAAIVTAFPSIPTPGTTLVPTTVTTYDLVFLLENANATGEDGFNKTRDSLINIITSLDQKEAENLRITVMMYSVTVTVEISRMELHHREQVVQRMRQLRWTEGAEVNTGHAVQSVYETITTDTHSDTPDQLVFLITQSPPTDVIQRPPSSTHKKIYPIGIGRKIRYEDLALLSFPDKPIMLDDPSDLRTLQPMLINISRTVRRPLLPTLPPRATLPPSVPCSKPMDVLFLLRASSGSQFEDLKTFVKTFIKSTNIGRNDTQVAVMVYGAKSAVAVTWRDEQTQDNLLKLLESLHGKTDNQPRLGAALRLAVQTAVSSTSGARMGIPKAVVMVVTDRSIDSVQEAANEALTAGVSVFPIGLGKQYDQIEVNTLAGPQAQENVILLGSTEYLLSMAAFDQSFPDKLCRAGPPGVCVDDEGNERKPGETWMLADGCHSVLCNPSGTITMQSHRINCEKMEPPVCKNNLPALRYNHHCGCTWTCPCSCMGSSTSHVVSFSGAALKVKSACSYLLLRSGGAELVLHTTACQSSPNQICMKSLELREGGTSVVLQDDMKVTVGGVLTAVPFRTERVTVTQIGSILHQLRSEQHGFTLTFTPHSNEFMLNMDIAMKPNTTGLCGSCSDDQSGLLLSDGSVTTDPDVYLQAWALGSECVQHQEIQLCPAGLEKACDVLSSEVFSHCHALVPVQDYIQICRSVACQPNALCDLVTAYSTVCRQQGVCVDWRTSSLCPMSCSDSMEYAACRSGCLEQCGQSQFTPGDMMGDGLLKANGSVCLNTPTEGCFCPEGSVLMEDKCVDREACSQCVEHSGKTHQFMESWNPEDNPCVLCVCLDQQRINCTALPCTNAKAPECGQCEVLQEKMGSKCCPQYECVCDINCKRPDPPHCDHGLSVVLTNPGDCLPVYQCVCKKDQCPDSTKPSCPAYKKLSVKASECCDSYQCLCNCQNITRTCPPGYITKTSTNDCQCTEVTCTPDKVCVVDAVVYQVGSRWEEKCKTCRCTEQTDGQTGLHIAQCVDPVCNQICPVGSTYSHSGGECCGHCRKSSCEEGGLLRQVGEQWVSANDRCVWSECVQVNEEVFIQHTNVSCHHMDTPACPLGTELQCNTVDDCCPSCHCVPMNACVLNQTVIAAGERVMLDVCTHCECVGDKRSYRLSCRKMSCSPCSEGYTMEPIPNACCGRCVATACSVRRPDGELITLKANTTRTDGCTKHTCSVNKDEELVLETLVTTCPPFDRKSCLEHGGKISQIGDTCCNMCTEPECRRTVGLLNYIRVDDCQSEEKIELTYCEGKCGSKSVYSLEKHKVENECVCCSATGTVPMNVSLRCANGTQTHHQVLAVTGCDCMSHTCSND

SEQ ID NO: 84 - protein, 2812 aa, Danio rerio; identical to SEQ ID NO: 83

SEQ ID NO: 85 - protein, 2842 aa, Xenopus tropicalis
MKHLLFLALGLIYKFTTGPLVAEGKLDWSVLARCSLFGENHIQTFDGTFYDFYGDCSYMLAGDCNKHSFSLLADYRNGKKKSVSLYLGEYFDIHLFLDGTATQGEKHISMPYASNGIFLESEAGYYKLSSQEHGFMVKIDASGNVQVVLPSKHFNKTCGLCGNYNQFAEDDFMMQEGILTENSYDFANSWALHGGARRCRRTYPPSNTCNISSETAEKDFMQRCQMLKTSSAFMQCHHLVDPDPYIAICEDDMCECAEELNCPCQTFLEYARTCAQHGVITSNWPTHTICKPLCPFGMEYNECVSPCVKTCQSLNINEVCQEQCIDGCSCPDGKVLDGDRCIPVFECSCIHSGKRYPPGSAIRRDCNSCTCQNGAWECSNEDCPGECFVTGQSHFKSFDNKHFTFSGICQYLLATDAMDSTFSVTIETVQCADDIDAVCTRSASLRLLDMHNITIKLKHGGGVSLDGQDILLPLVQGFLRIQTTVLSAVRLTYKEDLQVDWDGHGKLLIKLSPIYSGLISGLCGNYNGNQGDDFLTPSGLIETSVEDFGNSWKLNGDCTDLMKQDTDPCNLNPKRARFSEEVCFALMDSAFQSCHNEVNPAPYLKNCRYDVCSCSNGKECLCSALSTYAAACSRKGILIDWRTPEFCPIQCSEGKIYQQCGSPCNQTCRSLSHPDVDCREFCMEGCYCPPGLYTNEDGECVPKSDCSCYYDGELFQPDDVFSNHYSMCYCENGLMHCSTSDVPSGYFPESFFNQPPARVKRSLDCRPPLNKIICPADNPKATGIECAKTCQNYELECVSHGCISGCTCPDGMVRHKSKCMFPQRCPCFHAGKEYAPGSSVEIDCNTCVCENRKWKCTENICDATCSAIGVSHYLTFDGFRYKFPGDCQYVLAQDYCGGVTGTFRILVGNEGCGFSGEKCTKRITILFRNGEIELTNEQIHIKKPLSDETSFDVLKSGNYFILLLGNQMSVTWDKGMRVYVTLKETYRDKVCGLCGNFDGIENNDLISSNNQIEMDPVNFGNSWKVNPLCADAAKFGAVSPLSLCKDNLMKQMAAENACNILMGDLFAECAKVVNPEPYWEICTYDTCTCESAGDCACFCDSLAAYAHVCAQRGINVHWRSSHLCPQSCEEKNQRDLDYVCEWRYNSCTTACPVTCQHPEPVNCPLKCVEGCQAYCPPGKILDEVSESCIEPKDCPVCTIEGHTVPHGRKIILNHDDPQRCQLCHCEGKNLQCNACEISVITTVAPTTLPVDITPTTEVVDTSIYECNKMMDLVFLVDGSSKLSMEEFEVVKDFIVGIMEKIHISQKKIRVSVVHYYSATTDRSFGLKDNKKLSELVKMVKSMKYVGSLTSSAPEALKYASHYVFGEAPRDNAPKFAMLLTASKSPKSVAGIMKAIHKRKITVIPVGLGPDINMEEINIIQKMSPKNKPYIFGSVYELLDRRDEIIHYLCDLVPEPPKPTIPSTKKPTVTEKPVQKVTIAPVEKGPTATQIPEVKPTTQASWDKTIDLVFIIEGSDKVGEINFNKTKIFLEKMIQKLQISEETIHITIIQFSFTVTIEYSFSEKQTKEDIIQRIRKMEYRGGNATNTGKAINYVTEHTFTTDTGSRNDIPHLVYMVTSNPATDIITKGPSDINMVPIAVGPNVDIQELELIANSRDEIILIEDYDVLISDAPVLVLEKCCSRKSLSTTPFPPTTTPATQPITDNCEKPMDVIFVLDGSSSVRASQFEEMKTFVKAFIKKVNIGVGATQVSVLQYGWRNILEIAWTDPQEKESLLKAVDNIQKAEDGPAKIGEALLFGVRTAMSEVHGARPGSTKIAVIVITDVSVDQVAEAANSAVINRVSVFPIGIGTRYDSQQLKVLAGPSANKKITKLQIIEDLPTMVTLSNEFINKICTEFATVCIDEEGKQRKPGDKWMLTDKCHSVTCLPDGKTLLESHKVNCEKIPKPMCHNNLPAMKIEETCGCRWTCPCMCMGSSTRHIVTFDGLDFKLMGACSYVLFHDEVHDVKVILHNAECNTTNHQTCMKSVEVKHNKYSILLSSNMQVSVNGDIVPLPYANDNFEVTLYGEIVHEVKIPQLGFVFTFTPANNEFVLQLNPAAFSLRTSGLCGICDQNTVNDFTLSDGSVTTDSSKFIKEWTVVDSLGRTCETKPDKACTQPISSECKIMLSKTFEACHTIFPPKPYFTVCEEASCHGQDICEVIAAYVHVCRINGVCINWRTPDFCPMECPRLMVYHHCHMGCNKECGKTLNGTLCSDSSTEGCFCPEGDVTVNGKCVNEKVCSQCTDRYGEEHQLLETWIPTNAPCSICMCLENRMINCTAMPCPTVKPLTCGPCEIPRLKKTSEQCCPDYECVCDLTTCDVNPVPHCENGLVPVLTNPGHCKPNYECACRIEECPNHKNLICPPYKQLALQKTACCDKYECVCSCTNSTVVCPTGYSSSIATNDCDCTSVTCIPDKVCLYNNDIHLAGSMWEDGCRSCTCTDKKDSVTGLLIAECLQQRCNTNCGQGFTYVKKAEECCGKCKKTVCEQKISPRGQGDIDFSGETTRWYNVGAMWNSPTDPCIINECAQVNDEVFILQKNVSCSEISTSKCPSGYELICMQGTECCPICQCEPIPGCRYNGSIIAPNTGIMIDECSSCECTTPRGLILSYKLTCKKRTCPSCPKNFILKKEEGSCCGQCIQTSCSVKLKNGTIIYVKPNETVRDGCDSHSCKINNLGELTREKRITSCPPFNREKCLTDGGKIKELDDSCCETCVEPECKQVTGIITYVRVDDCTSDRQLNLHYCEGKCTSKSSYDIETHSMKEQCICCSATHTEPMKVPLRCANGTMIEHEVLQARSCECMSHKCTQ

SEQ ID NO: 86 - protein, 2842 aa, Xenopus tropicalis; identical to SEQ ID NO: 85

SEQ ID NO: 87 - protein, 2813 aa, Macaca mulatta
MIPARLAGVLLALALVLPGTLCAEGTRGRSSMARCSLFGSDFINTFDGSMYSFAGYCSYLLAGDCQKRSFSIIGDFQNGKRVSLSVYLGEFFDIHLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAGGLECTCPAFLEYTRTCAQEGMVLYGWTDHSACSPVCPAGMEYKQCVSPCARTCQSLHINEVCQERCVDGCSCPEGQLLDEGLCVESTECPCMHSGKRYPPGASLSRDCNTCICRNSQWICSNEECPGECLVTGQSHFKSFDNRYFTFSGICQYLLARDCEDHSFSIVIETVQCADDPDAVCTRSVTVRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCLHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKAISVVWDRHLSISVVLKQTYQEKVCGLCGNFDGIQNNDLTSSNLQVEEDPVDFGNSWKVSSQCADTRKVPLDSSPATCHNNLMKQTMVDSSCRILTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLPCPVQCVEGCHAHCPPGKILDELLQTCVSPEDCPVCEAAGRRFASGKKVTLNPSDPEHCQICHCDGVNLTCEACEEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIHLIEKQSPENKAFVLSGVDELEQQRDEIVSYLCDLAPEAPPPTLSPDMAQVTVGPGLLGVSTLGPKRNSMVLDVAFVLEGSDKIGEADFNRSKEFMEEVIQRMDVGQDGIHVTVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVAPEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLESHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHAALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCRTNGVCVDWRTPDFCAMSCPPSLVYNPCERGCPRHCNGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPRCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPSGFQLSCKTSACCPSCRCEPVEACMLNGTMIGPGKSVMIDACTTCRCIVQVGIISGFKLECRKTICNPCPLGYKEENNTGECCGRCLPTVCTIRLRGGQIMTLKRDETLQDGCDTHFCKVNERGEYFWEKRVTGCPPFDEHKCLAEGGKIMKIPGTCCDTCEEPECSDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 88 - protein, 2813 aa, Macaca mulatta; identical to SEQ ID NO: 87

SEQ ID NO: 89 - protein, 3076 aa, Cricetulus griseus
MSPAPPSYRGNVAVRFCRARPLQGVKGAAFSSLHQQISDQQTSPSLLWAWLPCYFFAEELEATASLPPGEGLQIQVLYFLFCFRYLLHSLLPLDINGLDIVPLTGNYQDGKRVSLSVYLGEFFDIHLFANGTVMQGYQSIDMPYASKGLHLETEAGYYKLSSEAYGFVARIDGDGNFQVLMSDRHFNKTCGLCGDFNIFAEDDFRTQEGALTSDPYDFANSWALSGEEQRCKRASPPSSHCNSSSGDMHKAMWEQCQLLKSASVFARCHPLVDPEPFVALCEKTLCTCTTGPECSCPALLEYARTCAQEGMVLYGWTDHSACHPACPAGMEYKECVSPCTRTCQSLPISEVCQQQCVDGCGCPEGELLDEDRCVQSSECSCVHAGKRYPPGTSLSQDCNTCICRNSLWICSNEECPGECLVTGQSHFKSFDNRYFTFSGICQYLLARDCQDHSFSIVIETVQCADDPDAVCTRSVTLRLSALHNSLVKLKHGGGVAIDGQDVQIPFLQGGLHIQHTVMASVRLSYEEDLQMDWDGRGRLLVKLSPVYSGKTCGLCGNYNGNKGDDFLTPAGLVEPLVVDFGNAWKLQGDCPDLHMQHSDPCSLNPRLTRFAEEACALLTSSKFEACHHAISPLPYLQNCRYDVCSCSDGRDCLCSAVANYAAACARKGVHIGWREPDFCALGCPQGQVYLQCGNSCNLTCRSLSYPDEECNEVCLEGCFCPPGLYQDERGNCVPKAQCPCYYDGELFQPADIFSDHHTMCYCEDGFMHCTTSVGPGSLLPDIVLSSPLSHRSKRSLSCRPPMVKLVCPADNPRAQGLECAKTCQNYDLECMSLGCVSGCLCPPGMVRHENKCVALERCPCFHQGQEYAPGDKVKIDCNTCVCRDRRWNCTDHVCDATCSAIGMANYITFDGLKYLFPGECQYVLVQDYCGDNPGTFRILVGNEGCSYPSVMCKKRVTILVEGGEIELSDGEVNVKKPLKDESHFEVVESGRYVLLLLGPALSVVWDHHLSVSVVLKRTYQEQVCGLCGNFDGIQNNDFTSSSLQVEEDPVDFGNSWKVSSQCANTRKLSLDVPPATCHNNIMKQTMVDSSCRILTSDIFQGCNRLVDPEPYLDICIYDTCSCESIGDCACFCDTIAAYAHVCAQHGQVVPWRTPTLCPQSCEARNVQENGYECEWRYNSCAPACPVTCQHPEPLACPVQCVEGCHAHCPPGRILDELLQTCVDPQDCPVCEVAGRRLAPGKRITLSPDDPAHCQNCHCDGVNLTCEACGEPGGLVVPPTDGPVSSTTPYVEETPEPPLHSFYCSKLLDLVFLLDGSSRLSEAEFEVLKAFVVGTMERLHISQKRIRVAVVEYHDGSHAYIDLKDRKRPSELRRIASQVRYAGSQVASTSEVLKYTLFQIFGRIDRPEASRIVLLLTASQEPPRLARNLVRYVQGLKQKKIIVIPVGIGPHASLRQVRLIEKQAPENKAFLLSGVDELEQRRDEIISYLCDLAPEPRAPTKRPQVAQITTSPGTLGISSPGPKRKSMVLDVVFVLEGSDKVGEANFNKSKEFLEEVIRRMDVSQDGTHISVLQYSYTATVEYTFNEAQSKEDVLRHVREIRYHGGNRTNTGQALQYLSEYSFSPSQGDREQAPNLVYLVTGNPASDEIKRLPGDIQVVPIGVGPRANTQELERIGWPNAPIFIRDFETLPREAPDLVLQRCCSREGLQLPTLSPTPDCSQLLDVVLLLDGSSSLPESYFDMMKSFAKAFISKANIGPHLTQVSVLQYGSINTIDVPWNVAQEKAHLLSLVDLMQREGGPSKIGDALAFAVRYVTSQIHGARPGASKAVVILILGTSLDSVDTAADAARSNRVAVFPIGVGDRYDEAQLRILAGPGASSNVVKLQQVEDLPTIVTPGNSFFHRLCSGFSGVCVDEDGNEKRPGEVWTLPDQCHTVTCLPNGQTLLQSHRVNCDHGPRPSCSNSQSPVRVEETCGCRWTCPCVCTGSSTRHIITFDGQNFKLTGNCSYVLFHNKEQDLEVILHNGACSPGARQACMKSIEIKHGGLSVELHSDMEMSVNGRLVPAPYVGGDMEVSVYGAIMYEVRFNHLGHILTFTPQNNEFQLQLSPKTFASKMYGLCGICDENGANDFMLRDGTVTADWKRLIQEWTVQQPGYPCQPVPEEQCPVSDSSHCQVLLSALFAECHKVLAPATFHAICQQDSCHQERVCEVIASYAHLCRTNGVCVDWRTTDFCAMSCPASLVYNHCEHGCPRHCDGNTTSSCGDHPSEGCFCPQHQVMLEGSCVPEEACTQCIGEDGVRHQFLETWVPDHQPCQICVCLSGRKANCTAQPCPTARAPTCGPCEVARLKESANRCCPEYECECDLANCNLPPVPPCEGGFQPTLTNPGECRPTFTCACRKEECKRVSPPSCPPHRTPTLRKTQCCDEYECACSCVNSTLSCPLGYLASTTTNDCGCTTTTCLPDKVCVHRGTIYPVGQFWEEGCDTCTCTDMEDTVMGLRVAQCSQKPCEDSCQPGFSYVFHEGECCGRCLPSACKVMVGSPRGDSFSSWKNVGSRWAAPENPCLINECVRVEEAVFVQQRNISCPQLAVPTCPTGFQLSCETSECCPSCRCEPMEACLLNGTIIGPGKSVMVDLCTTCRCIVQTGATSRFKLECRKTTCAACPMGYREEKNEGECCGRCLPTACTIQLRGGQIMTLKRDETLQDGCDSHFCKVNERGEYIWEKRVTGCPPFDERRCLAEGGKIVKIPGTCCDTCEEPDCKDIVAKLQYVKVGDCKSQEEVDIHYCQGKCASKAVYSIDIEDVQQHCSCCGPSRTEPMRVPLHCTNGSVVYHEVINAMQCRCSPQKCSKGGPLNWAPAARVDDVVEKHGKSPMDLRDIPLLPGSPRRLSSRTVARGGQGPKQYLRVPSPRAPGQRDSSSGHSGQISRRECSHDNSVINNYLDANEPSSEARLSRMHFHDNQRKVDYVLAYHYRKRGAHQGHGSPGHSLAVISNGETGKERHAGGPGDIELGPLDALEEERRGQRDEFEHNLMAAGLELEKDLEVLLTFLPHSIMCPPKQLSTTTKPKSKQTKDQLEVFDK

SEQ ID NO: 90 - protein, 3099 aa, Cricetulus griseus
MKPERAKLYPEAKIQLSDKIRIHLGKLVYRTVVLWYISLVQTWAVVPFAVGSRSMNPARFEIWLLALALSWSGTLSTKKTGDRPSMARCSLFGDDFINTFDETMYSFAGGCSYLLAGDCQKHSFSIIGNYQDGKRVSLSVYLGEFFDIHLFANGTVMQGYQSIDMPYASKGLHLETEAGYYKLSSEAYGFVARIDGDGNFQVLMSDRHFNKTCGLCGDFNIFAEDDFRTQEGALTSDPYDFANSWALSGEEQRCKRASPPSSHCNSSSGDMHKAMWEQCQLLKSASVFARCHPLVDPEPFVALCEKTLCTCTTGPECSCPALLEYARTCAQEGMVLYGWTDHSACHPACPAGMEYKECVSPCTRTCQSLPISEVCQQQCVDGCGCPEGELLDEDRCVQSSECSCVHAGKRYPPGTSLSQDCNTCICRNSLWICSNEECPGECLVTGQSHFKSFDNRYFTFSGICQYLLARDCQDHSFSIVIETVQCADDPDAVCTRSVTLRLSALHNSLVKLKHGGGVAIDGQDVQIPFLQGGLHIQHTVMASVRLSYEEDLQMDWDGRGRLLVKLSPVYSGKTCGLCGNYNGNKGDDFLTPAGLVEPLVVDFGNAWKLQGDCPDLHMQHSDPCSLNPRLTRFAEEACALLTSSKFEACHHAISPLPYLQNCRYDVCSCSDGRDCLCSAVANYAAACARKGVHIGWREPDFCALGCPQGQVYLQCGNSCNLTCRSLSYPDEECNEVCLEGCFCPPGLYQDERGNCVPKAQCPCYYDGELFQPADIFSDHHTMCYCEDGFMHCTTSVGPGSLLPDIVLSSPLSHRSKRSLSCRPPMVKLVCPADNPRAQGLECAKTCQNYDLECMSLGCVSGCLCPPGMVRHENKCVALERCPCFHQGQEYAPGDKVKIDCNTCVCRDRRWNCTDHVCDATCSAIGMANYITFDGLKYLFPGECQYVLVQDYCGDNPGTFRILVGNEGCSYPSVMCKKRVTILVEGGEIELSDGEVNVKKPLKDESHFEVVESGRYVLLLLGPALSVVWDHHLSVSVVLKRTYQEQVCGLCGNFDGIQNNDFTSSSLQVEEDPVDFGNSWKVSSQCANTRKLSLDVPPATCHNNIMKQTMVDSSCRILTSDIFQGCNRLVDPEPYLDICIYDTCSCESIGDCACFCDTIAAYAHVCAQHGQVVPWRTPTLCPQSCEARNVQENGYECEWRYNSCAPACPVTCQHPEPLACPVQCVEGCHAHCPPGRILDELLQTCVDPQDCPVCEVAGRRLAPGKRITLSPDDPAHCQNCHCDGVNLTCEACGEPGGLVVPPTDGPVSSTTPYVEETPEPPLHSFYCSKLLDLVFLLDGSSRLSEAEFEVLKAFVVGTMERLHISQKRIRVAVVEYHDGSHAYIDLKDRKRPSELRRIASQVRYAGSQVASTSEVLKYTLFQIFGRIDRPEASRIVLLLTASQEPPRLARNLVRYVQGLKQKKIIVIPVGIGPHASLRQVRLIEKQAPENKAFLLSGVDELEQRRDEIISYLCDLAPEPRAPTKRPQVAQITTSPGTLGISSPGPKRKSMVLDVVFVLEGSDKVGEANFNKSKEFLEEVIRRMDVSQDGTHISVLQYSYTATVEYTFNEAQSKEDVLRHVREIRYHGGNRTNTGQALQYLSEYSFSPSQGDREQAPNLVYLVTGNPASDEIKRLPGDIQVVPIGVGPRANTQELERIGWPNAPIFIRDFETLPREAPDLVLQRCCSREGLQLPTLSPTPDCSQLLDVVLLLDGSSSLPESYFDMMKSFAKAFISKANIGPHLTQVSVLQYGSINTIDVPWNVAQEKAHLLSLVDLMQREGGPSKIGDALAFAVRYVTSQIHGARPGASKAVVILILGTSLDSVDTAADAARSNRVAVFPIGVGDRYDEAQLRILAGPGASSNVVKLQQVEDLPTIVTPGNSFFHRLCSGFSGVCVDEDGNEKRPGEVWTLPDQCHTVTCLPNGQTLLQSHRVNCDHGPRPSCSNSQSPVRVEETCGCRWTCPCVCTGSSTRHIITFDGQNFKLTGNCSYVLFHNKEQDLEVILHNGACSPGARQACMKSIEIKHGGLSVELHSDMEMSVNGRLVPAPYVGGDMEVSVYGAIMYEVRFNHLGHILTFTPQNNEFQLQLSPKTFASKMYGLCGICDENGANDFMLRDGTVTADWKRLIQEWTVQQPGYPCQPVPEEQCPVSDSSHCQVLLSALFAECHKVLAPATFHAICQQDSCHQERVCEVIASYAHLCRTNGVCVDWRTTDFCAMSCPASLVYNHCEHGCPRHCDGNTTSSCGDHPSEGCFCPQHQVMLEGSCVPEEACTQCIGEDGVRHQFLETWVPDHQPCQICVCLSGRKANCTAQPCPTARAPTCGPCEVARLKESANRCCPEYECECDLANCNLPPVPPCEGGFQPTLTNPGECRPTFTCACRKEECKRVSPPSCPPHRTPTLRKTQCCDEYECACSCVNSTLSCPLGYLASTTTNDCGCTTTTCLPDKVCVHRGTIYPVGQFWEEGCDTCTCTDMEDTVMGLRVAQCSQKPCEDSCQPGFSYVFHEGECCGRCLPSACKVMVGSPRGDSFSSWKNVGSRWAAPENPCLINECVRVEEAVFVQQRNISCPQLAVPTCPTGFQLSCETSECCPSCRCEPMEACLLNGTIIGPGKSVMVDLCTTCRCIVQTGATSRFKLECRKTTCAACPMGYREEKNEGECCGRCLPTACTIQLRGGQIMTLKRDETLQDGCDSHFCKVNERGEYIWEKRVTGCPPFDERRCLAEGGKIVKIPGTCCDTCEEPDCKDIVAKLQYVKVGDCKSQEEVDIHYCQGKCASKAVYSIDIEDVQQHCSCCGPSRTEPMRVPLHCTNGSVVYHEVINAMQCRCSPQKCSKGGPLNWAPAARVDDVVEKHGKSPMDLRDIPLLPGSPRRLSSRTVARGGQGPKQYLRVPSPRAPGQRDSSSGHSGQISRRECSHDNSVINNYLDANEPSSEARLSRMHFHDNQRKVDYVLAYHYRKRGAHQGHGSPGHSLAVISNGETGKERHAGGPGDIELGPLDALEEERRGQRDEFEHNLMAAGLELEKDLEVLLTFLPHSIMCPPKQLSTTTKPKSKQTKDQLEVFDK

SEQ ID NO: 91 - protein, 2794 aa, Papio anubis
PGTFCAEGTRGRSSMARCSLFGSDFINTFDGSMYSFAGYCSYLLAGDCQKRSFSIIGEFQSGKRASLSVYLGEFFDIRLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAEGLECTCPAFLEYARTCAHEGMVLYGWTDHSACSPVCPAGMEYKQCVSPCARTCQSLHINEVCQERCMDGCSCPEGQLLDEGLCVESTECPCMHSGKRYPPSASLSRDCNTCICRNSQWICSNEECPGECLVTGQSHFKSFDNRYFTFSGICQYLLARDCQDHSFSIVIETVQCADDPDAVCTRSVTIRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAISPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGGDPGTFRILVGNEGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPADFGNSWKVSSQCADTRKVPLDSSPATCHNLMKQTMVDSSCRVLTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACKEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLIEKQSPDNKAFVLSGVDELEQQRDEIVSYLCDLAPEAPPPTLPPDMAQVTVGPGLLGVSTLGPKRNSMVLDVAFVLEGSDKIGEADFNRSKEFMEEVIQRMDVGQDGIHVAVLQYSYTVAVEYPFSEAQSKGDILQRVREIRYQGGNRTNTGLALQYLSEHSFLVSGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVALEKAHLLSLVDVMQREGGPSQIGNDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHGALSVELHSDMEVTVNGRLVSVPYVGGNMEVNVYGAIMHEIRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCWTNGVCVDWRTPDFCAMSCPPSLVYNPCERGCPRHCDGNVSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGFQPTLTNPGECRPNFTCACRKEECKRVSPPSCPPHRLPALRKTQCCDEYECACNCVNSTVSCPLGYLASTATNDCGCTTTTCLPDKVCVHRSTIYPMGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPLGFQLSCKTSACCPSCHCEPVEACMLNGTMIGPGKSVMIDACTTCRCIVQVGIISGFKLECRKTICNPCPLGYKEENNTGECCGRCLPTTCTIRLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 92 - protein, 2813 aa, Chlorocebus sabaeus
MIPARFAGVLLALALILPGTLCAEGTRGRSSMARCSLFGSDFINTFDGSMYSFAGYCSYLLAGDCQKRSFSIIGDFQSGKRVSLSVYLGEFFDIRLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEMQKGLWEQCQLLKSTSVFARCHPLVDPEPFVALCEKTSCECAGELECTCPAFLEYARTCAQEGMVLYGWTDHSACSPVCPAGMEYKQCVSPCTRTCQSLHVNEVCQERCVDGCSCPEGQLLDEGLCVESTECPCMHSGKRYPPGASLSRDCNTCICRNSQWICSNEECPGECLVTGQSHFKSFDNRYFTFSGICQYLLARDCQDHSFSIVIETVQCADDPDAVCTRSATVRLPGLHNSLVKLKHGGGVAMDGQDVQLPLLKGDLRIQHSVTASVRLSYGEDLRMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNLMKQTMVDSSCRILTSDVFQDCNKLVDPEPFLDICIYDTCSCESIGDCACFCDTIAAYAHVCAQHGKLVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACEEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLVEKQSPENKAFVLSGVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYTVAVEYPFSEAQSKGDILQRVREIRYQGGNRTNTGLALQYLSEHSFLASQGDREQAPNLVYMVTGNPASDEIKRLPGDIQVVPIGVGPHASVRELERIGWPNAPILIQDFETLPREAPDLVLQSCCSGEGLKIPTLSPAPDCSQPLDVILLLDGSSSFPASYFDEMKSFAKAFISKANIGPHLTQVSVLQYGSITTIDVPWNAALEKAHLLSLVDVMQREGGPSQIGDALGFAVRYLTSEIHGARPGASKAVVILVMDVSVDSVDAAADAARSNRVTVFPIGIGDRYDAAQLRILAGPAGNSNVVKLQRIEDLPTMVTLGNSFLHKLCSGFVRICMDEDGNEKKPGDIWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHGALSVELHSDMEVTVNGRLVSVPYVGGNMEVNVYGAIMHEIRFNHLGHIFTFTPQNNEFQLQLSPKTFASKMYGLCGICDENGANDFMLRDGTVTTDWKTLVQEWTVQRPGQTCQPILEEQCLVPNSSQCQVLLSAPFAECHKVLAPATFYAICQQDSCHRQQVCEVIASYAHLCRTNGVCVDWRTPDFCAMSCPPSLVYNPCERGCPRHCDGNVSSCGDHPSEGCFCPPNKVMLEGSCVPEEACTQCIGEDGVQHQFLEAWVPDHQPCQICTCLSGRKANCTVQPCPTAKAPTCGLCEVARLRQNADQCCPEYECVCDPESCDLPPVPHCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACKVVTGSPRGDSQSSWKSVGSHWASPENPCLINECVRVKEEVFVQQRNVSCPQLEVPVCPSGFQLSCKTSACCPSCHCEPVEACMLNGTMIGPGKSVMIDACTTCRCIVQVGIISGFKLECRKTICNPCPLGYKEENNTGECCGRCLPTACTIRLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNALQCECSPRKCSK

SEQ ID NO: 93 - protein, 2794 aa, Macaca mulatta
MIPARLAGVLLALALVLPGTLCAEGTRGRSSMARCSLFGSDFINTFDGSMYSFAGYCSYLLAGDCQKRSFSIIGDFQNGKRVSLSVYLGEFFDIHLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAGGLECTCPAFLEYTRTCAQEGMVLYGWTDHSACSPVCPAGMEYKQCVSPCARTCQSLHINEVCQERCVDGCSCPEGQLLDEGLCVESTECPCMHSGKRYPPGTCPGDWGGGLGECLVTGQSHFKSFDNRYFTFSGICQYLLARDCEDHSFSIVIETVQCADDPDAVCTRSVTVRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCLHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKAISVVWDRHLSISVVLKQTYQEKVCGLCGNFDGIQNNDLTSSNLQVEEDPVDFGNSWKVSSQCADTRKVPLDSSPATCHNNLMKQTMVDSSCRILTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLPCPVQCVEGCHAHCPPGKILDELLQTCVSPEDCPVCEAAGRRFASGKKVTLNPSDPEHCQICHCDGVNLTCEACEEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIHLIEKQSPENKAFVLSGVDELEQQRDEIVSYLCDLAPEAPPPTLSPDMAQVTVGPGLLGVSTLGPKRNSMVLDVAFVLEGSDKIGEADFNRSKEFMEEVIQRMDVGQDGIHVTVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVAPEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLESHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHAALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCRTNGVCVDWRTPDFCAMSCPPSLVYNPCERGCPRHCNGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPRCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPSGFQLSCKTSACCPSCRCGKSCRLGLCWPGKSVMIDACTTCRCIVQVGIISGFKLECRKTICNPCPLGYKEENNTGECCGRCLPTVCTIRLRGGQIMTLKRDETLQDGCDTHFCKVNERGEYFWEKRVTGCPPFDEHKCLAEGGKIMKIPGTCCDTCEEPECSDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 94 - protein, 2824 aa, Macaca mulatta
MPCQRKVAALLMIPARLAGVLLALALVLPGTLCAEGTRGRSSMARCSLFGSDFINTFDGSMYSFAGYCSYLLAGDCQKRSFSIIGDFQNGKRVSLSVYLGEFFDIHLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAGGLECTCPAFLEYTRTCAQEGMVLYGWTDHSACSPVCPAGMEYKQCVSPCARTCQSLHINEVCQERCVDGCSCPEGQLLDEGLCVESTECPCMHSGKRYPPGASLSRDCNTCICRNSQWICSNEECPGECLVTGQSHFKSFDNRYFTFSGICQYLLARDCEDHSFSIVIETVQCADDPDAVCTRSVTVRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCLHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKAISVVWDRHLSISVVLKQTYQEKVCGLCGNFDGIQNNDLTSSNLQVEEDPVDFGNSWKVSSQCADTRKVPLDSSPATCHNNLMKQTMVDSSCRILTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLPCPVQCVEGCHAHCPPGKILDELLQTCVSPEDCPVCEAAGRRFASGKKVTLNPSDPEHCQICHCDGVNLTCEACEEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIHLIEKQSPENKAFVLSGVDELEQQRDEIVSYLCDLAPEAPPPTLSPDMAQVTVGPGLLGVSTLGPKRNSMVLDVAFVLEGSDKIGEADFNRSKEFMEEVIQRMDVGQDGIHVTVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVAPEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLESHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHAALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCRTNGVCVDWRTPDFCAMSCPPSLVYNPCERGCPRHCNGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPRCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPSGFQLSCKTSACCPSCRCEPVEACMLNGTMIGPGKSVMIDACTTCRCIVQVGIISGFKLECRKTICNPCPLGYKEENNTGECCGRCLPTVCTIRLRGGQIMTLKRDETLQDGCDTHFCKVNERGEYFWEKRVTGCPPFDEHKCLAEGGKIMKIPGTCCDTCEEPECSDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 95 - protein, 2813 aa, Mus musculus
MNPFRYEICLLVLALTWPGTLCTEKPRDRPSTARCSLFGDDFINTFDETMYSFAGGCSYLLAGDCQKRSFSILGNFQDGKRMSLSVYLGEFFDIHLFANGTVTQGDQSISMPYASQGLYLEREAGYYKLSSETFGFAARIDGNGNFQVLMSDRHFNKTCGLCGDFNIFAEDDFRTQEGTLTSDPYDFANSWALSSEEQRCKRASPPSRNCESSSGDMHQAMWEQCQLLKTASVFARCHPLVDPESFVALCEKILCTCATGPECACPVLLEYARTCAQEGMVLYGWTDHSACRPACPAGMEYKECVSPCPRTCQSLSINEVCQQQCVDGCSCPEGELLDEDRCVQSSDCPCVHAGKRYPPGTSLSQDCNTCICRNSLWICSNEECPGECLVTGQSHFKSFDNRYFTFSGICQYLLARDCEDHTFSIVIETMQCADDPDAVCTRSVSVRLSALHNSLVKLKHGGAVGIDGQDVQLPFLQGDLRIQHTVMASVRLSYAEDLQMDWDGRGRLLVKLSPVYSGKTCGLCGNYNGNKGDDFLTPAGLVEPLVVDFGNAWKLQGDCSDLRRQHSDPCSLNPRLTRFAEEACALLTSSKFEACHHAVSPLPYLQNCRYDVCSCSDSRDCLCNAVANYAAECARKGVHIGWREPGFCALGCPQGQVYLQCGNSCNLTCRSLSLPDEECSEVCLEGCYCPPGLYQDERGDCVPKAQCPCYYDGELFQPADIFSDHHTMCYCEDGFMHCTTSGTLGSLLPDTVLSSPLSHRSKRSLSCRPPMVKLVCPADNPRAQGLECAKTCQNYDLECMSLGCVSGCLCPPGMVRHENKCVALERCPCFHQGAEYAPGDTVKIGCNTCVCRERKWNCTNHVCDATCSAIGMAHYLTFDGLKYLFPGECQYVLVQDYCGSNPGTFQILVGNEGCSYPSVKCRKRVTILVDGGELELFDGEVNVKRPLRDESHFEVVESGRYVILLLGQALSVVWDHHLSISVVLKHTYQEQVCGLCGNFDGIQNNDFTTSSLQVEEDPVNFGNSWKVSSQCADTRKLSLDVSPATCHNNIMKQTMVDSACRILTSDVFQGCNRLVDPEPYLDICIYDTCSCESIGDCACFCDTIAAYAHVCAQHGQVVAWRTPTLCPQSCEEKNVRENGYECEWRYNSCAPACPVTCQHPEPLACPVQCVEGCHAHCPPGRILDELLQTCVDPQDCPVCEVAGRRLAPGKKITLSPDDPAHCQNCHCDGVNLTCEACQEPGGLVAPPTDAPVSSTTPYVEDTPEPPLHNFYCSKLLDLVFLLDGSSMLSEAEFEVLKAFVVGMMERLHISQKRIRVAVVEYHDGSRAYLELKARKRPSELRRITSQIKYTGSQVASTSEVLKYTLFQIFGKIDRPEASHITLLLTASQEPPRMARNLVRYVQGLKKKKVIVIPVGIGPHASLKQIRLIEKQAPENKAFLLSGVDELEQRRDEIVSYLCDLAPEAPAPTQPPQVAHVTVSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPTLPPLPDCSQPLDVVLLLDGSSSLPESSFDKMKSFAKAFISKANIGPHLTQVSVIQYGSINTIDVPWNVVQEKAHLQSLVDLMQQEGGPSQIGDALAFAVRYVTSQIHGARPGASKAVVIIIMDTSLDPVDTAADAARSNRVAVFPVGVGDRYDEAQLRILAGPGASSNVVKLQQVEDLSTMATLGNSFFHKLCSGFSGVCVDEDGNEKRPGDVWTLPDQCHTVTCLANGQTLLQSHRVNCDHGPRPSCANSQSPVRVEETCGCRWTCPCVCTGSSTRHIVTFDGQNFKLTGSCSYVIFQNKEQDLEVLLHNGACSPGAKQACMKSIEIKHAGVSAELHSNMEMAVDGRLVLAPYVGENMEVSIYGAIMYEVRFTHLGHILTYTPQNNEFQLQLSPKTFASKMHGLCGICDENGANDFTLRDGTVTTDWKRLVQEWTVQQPGYTCQAVPEEQCPVSDSSHCQVLLSASFAECHKVIAPATFHTICQQDSCHQERVCEVIASYAHLCRTSGVCVDWRTTDFCAMSCPPSLVYNHCERGCPRHCDGNTSFCGDHPSEGCFCPQHQVFLEGSCVPEEACTQCVGEDGVRHQFLETWVPDHQPCQICMCLSGRKINCTAQPCPTARAPTCGPCEVARLKQSTNLCCPEYECVCDLFNCNLPPVPPCEGGLQPTLTNPGECRPTFTCACRKEECKRVSPPSCPPHRTPTLRKTQCCDEYECACSCVNSTLSCPLGYLASATTNDCGCTTTTCLPDKVCVHRGTVYPVGQFWEEGCDTCTCTDMEDTVVGLRVVQCSQRPCEDSCQPGFSYVLHEGECCGRCLPSACKVVAGSLRGDSHSSWKSVGSRWAVPENPCLVNECVRVEDAVFVQQRNISCPQLAVPTCPTGFQLNCETSECCPSCHCEPVEACLLNGTIIGPGKSVMVDLCTTCRCIVQTDAISRFKLECRKTTCEACPMGYREEKSQGECCGRCLPTACTIQLRGGRIMTLKQDETFQDGCDSHLCRVNERGEYIWEKRVTGCPPFDEHKCLAEGGKIVKIPGTCCDTCEEPDCKDITAKVQYIKVGDCKSQEEVDIHYCQGKCASKAVYSIDIEDVQEQCSCCLPSRTEPMRVPLHCTNGSVVYHEVINAMQCRCSPRNCSK

SEQ ID NO: 96 - protein, 2813 aa, Macaca mulatta; identical to SEQ ID NO: 87

SEQ ID NO: 97 - protein, 2813 aa, Pongo abelii
MIPARFAGVLLALALILPGTLCAEGTRGRSSMARCSLFGSDFINTFDGSMYSFAGYCSYLLAGDCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECTCPAFLEYARTCAQEGMVLYGWTDHSACSPVCPAGMEYKQCVSPCARTCQSLHINEVCQERCVDGCSCPEGQLLDEGLCMESTKCPCMHSGKRYPPGASLSRDCNTCICRNSQWICSNEECPGECLVTGQSHFKSFDNRYFTFSGICQYLLARDCQDHSFSIVIETVQCADDRDAVCTRSVTVRLPGLQDSLVKLKHGGGVAMDGQDVQLPLLKGDLRIQHTVTASVRLSYGEDLQMDWDGRGRLLVKLSPVYAGKTCGLCGNYNGNQGDDFLIPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMNGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGETVKIGCNTCVCRDRKWNCTDHVCDATCSTIGMAHYLTFDGLKYMFPGECQYVLVQDYCGSNPGTFRILVGNEGCSHPSVKCEKRVTILVEGGEIELFDGEVNVKRPMKDETHFEVVESGRYIILLLGKALSVVWDHHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPRSCEERNLRENGYECEWRYNSCAPACRVTCQHPEPLACPVQCVEGCHAHCPPGKILDELLQTCVDPEDCPVCEVAGRRFASGKKVTLNPSDPEHCQICHCDGVNLTCEACQEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSGVDELEQQRDEMVSYLCDLAPEARPPTLPPHMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALQYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAADCSQPLDVILLLDGSSSFPASYFDEMKSFAKAFISKANIGPHLTQVSVLQYGSITTIDVPWNVAPEKAHLLSLVDVMQREGGPSQIGDALGFAVRYLTSEMHGARPGVSKAVVILVTDISVDSVDAAADAARSNRVAVFPIGIGDRYDAAQLRILAGPAGDSNMVKLQRIEDLPTMVTLGNSFLHKLCSGFVRICMDEDGNEKRPGDVWTLPDQCHTVTCQPDGQTLLKSHRVNCDRGPRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVMVNGRLVSVPYVGGNMEVNVYGAIMHEVRFNHLGHIFTFTPQNNEFQLQLSPKTFASKTYGLCGICDENGANDFILRDGTVTTDWKTLVQEWTVQRPGQMCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPNKVMLEGSCVPEEACTQCIGEDGVQHQFLEAWVPDHQPCQICTCLSGRKVNCTTQPCPTAKDLTCGLCEVARLRQNADQCCPEYECVCDLVSCDLPPVPHCEGGLQPTLTNPGECRPNFICACRKEECERVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERVEACTLNGTIIGPGKSVMIDVCTTCRCVVQVGVISGFKLECRKTTCNPCPLGYKEEDNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 98 - protein, 2816 aa, Callithrix jacchus
MIPARFARVLLALALTLPGILCAEGTRGRSSMARCSLFGSDVINTFDGSMYSFAGYCSYLLAGDCQKHSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNLNIFAEDDFMTQEGTLTSDPYDFANSWALSSGEQWCERASPPSGSCNISSGEMQKGLWEQCQLLKSTSVFARCHPLVDPEPFVALCEKTLCECTEGLECVCPTFLEYARTCAQEGMVLYGWTNHGACSPVCPAGMEYKQCVPPCTRTCQSLHINEVCQQQCVDGCSCPEGQLLDEGLCVESTECPCMHSGKRYPPGTNLSQDCNTCICRNSQWVCSNEDCPGECLVTGQSHFKSFDNKYFTFSGICQYLLARDCQDHSFSIVIETVQCADDPDAVCTRSVTIRLPGLHNSLVKLKHGGGVAMDGQDVQLPLLKGDLRIQHTVTTSVHVNYGEDLQMDWDGRGRLLVKLSPVYSGKTCGLCGNYNGNQGDDFLTPSGLAEPRVEDFGNAWKLHGDCQDLQKQHSDPCALNPRMTRFAEEACAVLTSPTFEACHRAVSPLPYLRNCRYDVCSCSDGRECLCGALASYAAACAGRGVRIAWREPGRCELNCPKGQVYLQCGTPCNLTCRSLSYPDEECSEDCLEGCFCPPGLYMDEMGNCVPKAQCPCYYDGEIFQPEDIFSDHHTVCYCEGGFMHCTMSEVPGSLLPDAVLSSPLSHRSKRSLSCRPPMVKLVCPADNPRAEGLECAKTCQNYDLECMSMGCVSGCLCPPGMVRHENRCVALERCPCFHQGQEYAPGETVKIDCNTCVCRDRKWNCTDHMCDATCSTIGMAHYLTFDGLKYMFPGECQYVLVQDYCDSNPGTFRILVGNEGCSYPSVKCKKRVTILVEGGEIELFDGEVNVQRPMKDETHFEVVESGRYIILLLGKALSVVWDRHLSISVVLKQTYQEQVCGLCGNFDGIQNNDLTSSNLQVEEDAVNFGNSWKVSSQCADTRRVPLDSSPATCRNNIMKQTMVDSSCRILTSDVFQDCNKLVDPEPYLDACIYDTCSCESIGDCTCFCDTVAAYAHMCAQHGKVVTWRTTTLCPQSCEERNLRESGYECEWRYNSCAPACRITCQHPEPLACPVQCVEGCHAHCPPGKILDELLQTCVNPEDCPVCEVAGRRLASGKKVTLNPSDPEHCQICHCDGVNLTCEACQEPEGLVMPPTDAPVSPTTPYVEDVSEAPLHDFYCSKLLDLVFLLDGSSRLSEAEFEVLKAFVVDMMERLRISQKWVRVAVVEYHDGSHAYIGLKDRKRPSELRRIASQVKYAGSQVASTSEVLKYTLFQVFGKIDRPEASRIILLLMASQEPQRMSRNFVRYVQGLKKKKVIVIPVGIGPHANLKQIRLIEKQAPENKAFVLSGVDELEQQRDEIVSYLCDLAPEAPPPTMPPHMAQVTVGPGLLGVSPLGPKRKSMVLDVAFVLEGSDKIGEADFNRTKEFMAEVIQRMDVGQDGIHVTVLQYSYMVTVEYPFSEAQTKGDILQRVRDIRYQGGNRTNTGLALQHLSEHSFLVSQGDREQAPNLVYMVTGNPASDEIKRLPGDIQVVPIGVGPHANVQELETIGWPNAPILIQDFETLPREAPDLVLQRCCSGEGLQMPKLAPDPDCSQPLDVVLLLDGSSSSPASYFDEMKSFAKAFISKANLGPHLTQVSVLQYGSITTIDVPWNAAMEKAHLLSLVDVMQREGGPSQIGNVGNALDFAVRYLTSEVHGARPGASKAVVILVTDVSVDSVGAAADAARANRVTVFPIGIGDRYDAAQLRTLAGPAADSNVVSLQRIEDLPTMVTLGNSFLHKLCSGFVRICMDEDGNEKRPGDVWTLPDQCHTVTCQPDGQTLLKSHRVNCDRGPRPSCPNSQSPLKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVAGNVEVSIYGAIMHEVRFNHLGHIFTFTPQNNEFQLQLSPKTFASKTYGLCGICDENGANDFMLRDGTVTTDWKTLVQEWTVQQSGQTCQPILEEQCLVSDSSQCQVLLSTLFAECHKVLAPATFYAICQQDSCHREQVCEVISSYAHLCRSSGVCVDWRTPDFCAMSCPSSLVYNHCERGCPRHCDGNVSSCGDHPSEGCFCPPNQVMLEGSCVPKEACTQCIGEDGVRHQFLKAWVPDHQPCQICTCLSGRKVNCTTQPCPTAKAPTCGLCEVAHLRQNADQCCPEYECVCDPVSCDLPAVPHCEDGLQPMLTNPGECRPNFTCACRKEECERVSPPSCPPHRFLTLRKTQCCDEYECACNCVNSTVSCPLGYLASTATNDCGCTTTTCLPDKVCVHRGTIYPVGQFWEEGCDVCTCTDMEDAVMGLRVAQCSQKPCEDSCRSGFTYVLHEGECCGRCLPSACEVVTGSRRGDSQSSWKSVGSRWASLENPCLINECVRVKEEVFVQQRNVSCPQLEVPFCPPGFQLSCKTSECCPRCRCEPMEACMLNGTIIGPGKSVMVDVCTACHCIVEAGAASGFQLECRKTTCKPCPLGYKEENNPGECCGRCLPTACTIRLRGGQIMTLKRDEMLQDGCDSHSCKVNEIGEYIWEKRVASCPPFDEHECLAEGGKIMKTPGTCCNRCEVPECKDITARLQYVKVGSCKSEVEVDIHYCQGKCASKAIYSIDIEDVQDQCSCCSPTRTEPMRVPLHCTNGSVVYHEILNAMQCKCSPRKCSK

SEQ ID NO: 99 - protein, 2798 aa, Macaca mulatta
MIPARLAGVLLALALVLPGTLCAEGTRGRSSMARCSLFGSDFINTFDGSMYSFAGYCSYLLAGDCQKRSFSIIGDFQNGKRVSLSVYLGEFFDIHLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAGGLECTCPAFLEYTRTCAQEGMVLYGWTDHSACSPVCPAGMEYKQCVSPCARTCQSLHINEVCQERCVDGCSCPEGQLLDEGLCVESTECPCMHSGKRYPPGTCPGDWGGGLGECLVTGQSHFKSFDNRYFTFSGICQYLLARDCEDHSFSIVIETVQCADDPDAVCTRSVTVRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCLHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKAISVVWDRHLSISVVLKQTYQEKVCGLCGNFDGIQNNDLTSSNLQVEEDPVDFGNSWKVSSQCADTRKVPLDSSPATCHNNLMKQTMVDSSCRILTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLPCPVQCVEGCHAHCPPGKILDELLQTCVSPEDCPVCEAAGRRFASGKKVTLNPSDPEHCQICHCDGVNLTCEACEEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIHLIEKQSPENKAFVLSGVDELEQQRDEIVSYLCDLAPEAPPPTLSPDMAQVTVGPGLLGVSTLGPKRNSMVLDVAFVLEGSDKIGEADFNRSKEFMEEVIQRMDVGQDGIHVTVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVAPEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLESHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHAALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCRTNGVCVDWRTPDFCAMSCPPSLVYNPCERGCPRHCNGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPRCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPSGFQLSCKTSACCPSCRCEPVEACMLNGTMIGPGKSVMIDACTTCRCIVQVGIISGFKLECRKTICNPCPLGYKEENNTGECCGRCLPTVCTIRLRGGQIMTLKRDETLQDGCDTHFCKVNERGEYFWEKRVTGCPPFDEHKCLAEGGKIMKIPGTCCDTCEEPECSDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 100 - protein, 2816 aa, Myotis lucifugus
MIPARLARVLLALVLTLPGTLCAERSLGRSPMARCSLFGDDFISTFDESMYSFAGDCSYLLAGDCQKHSFSLIGDFQNGKRVSLSVYLGEFFDIHLFVNGTVLQGDQSVSMPYASKGLYLETEAGYYKLSSEAYGFAARMDGSGSIQILLSDRYSNKTCGLCGNFNIFAEDDFRTQEGSLTSDPYDFANSWAMSSGEQRCKRASPSSSSCNASEEMKQGLWEQCQLLKRDSVFTRCHPLVDPEPFVALCERTLCTCTQGLRCPCAALLEYARACAHQGMVLYGWTEHSECRPACPAGMEYKECVSPCTRTCQSLKINEVCQEQCVDGCSCPEGQLLDEGRCVESTECSCVHSGKRYPPGASLSRDCNTWLCMNSSFICAKEGCPGECIITGQSHFKSFDDRYFTFSGVCQYLLARDCQDHSFSIVIETVQCADDPDAVCTRSVTARLPSLHNSLVKLKHGGGIAIDGQDVQLPLLQGDLRIQHTVLASVRLSYGEDLQMDWDGRGRLLVKLSPVYAGRTCGLCGNYNGNKGDDFRTPAGLVEPLVEDFGNAWKLHADCADLRQQHSDPCKLNPRLAKFAEEACSLLTSPKFEACHHAVGPLPYLQNCHYDVCSCSDGRDCLCSAVANYAAACARKGVHVAWREPSFCALSCPQGQVYLQCGTPCNMTCRSLSYPDEECTELCLEGCFCPPGLYLDERGDCVPKSQCPCYYDGEIFQPEDIFSDHHTMCYCEDGFMHCSTSGAPGSLLPQHIVFSGPLGPLSHRSKRSLSCRPPMVKLVCPADNPRAEGLECAKTCQNYDLECMSTGCVSGCLCPPGMVRHENRCVALERCPCFHQGKEYAPGETVKINCNTCVCRDRKWNCTDHVCDATCSTIGVAHYLTFDGLKYMFPGECQYVLVQDYCGSNPGTFRILVGNEGCGYPSVKCKKRVTILVEGGEIELFDGEVNVKRPMKDETHFEVVESGRYIILLLGKALSVVWDHHLTISVVLKQTYQEQVCGLCGNFDGVQNNDFTGSNLQVEEDPVDFGNSWKVSPQCADTRKVPLDSSPATCHNNIMKQSMVDSSCRILTSDLFQDCNKLVDPEPFLDVCIYDTCSCESIGDCACFCDTIAAYAHVCAQHGKVVNWRTATLCPQNCEERNIRENGYECEWRYNSCAPACPITCQHPEPLACPVQCVEGCHAHCPPGKILDELLQTCVDPRDCPVCEVSGRRLPPGKKVTLNPGDPEHCQICHCDGVNLTCEACREPEGLEVPPTEGPVSPTTPYVEDTPEPPLHDFFCSKLLDLVFLLDGSSKLSPAEFEVLKVFVVDMMERLHISQKRIRVALVEYHEGSHAYIQLRDRKRPSEMRRLASQVKYAGSAVASTSEVLKYTLFQIFGKIDRPEASRIALLLTASQEPQKLGRNLVRYVQGLKKKKVIVVPVGIGPHANLKQIRLIEKQAPENKAFVLSSVDELEQQRDEIINYLCDLAPEAPAPTQPPPMAQVTVGPEHLGVSTLGPKRNSMVLDVVFVLEGSDQIGEANFNRSKEFLEAVIRRMEVGQESIHVTVLQYSYTVTVETTFRETQSKQDVLQRVREIRYQGGNSTNTGLALQYVSEHTFSASLGDREQAPNLVYMVTANPASDVIKRMPGDIQVVPIGVGPHANVPELERIGWPNEPILIQDFETLPREAPDLVLQRCCSGEGLQIPTLSPAPDCSQPLDVILLLDGSSGFPASYFDEMKSFAKAFISKANIGPQLTHVSVLQYGSITTVDVPWNVAQEKTQLLGLVDQMQQEGGPSQIGDALGFAVRYITSEGHGARPGASKAVVILVMGASTDSVAAAAEAARSNRVTVFPIGIGDRYDPAQLKILAGPGASSNVVKLQHIEDLPTIVTLGNSFLHKLCSGYIGVCMDEDGNEKRPGDVWTLPDQCHTVTCLPDGQTLLNSHRVNCERGPKPSCPNSQSPVRVEETCGCRWTCPCVCMGSSTRHIVTFDGQNFKLTGSCSYVLFQNKEQDLELILHNGACSPGARQACMKSIEVKHNGLSVELHSDMEVGVNGILVSVPYMGGDMEVNIYGAIMYEIRFNHLGHIFTFTPQNNEFQLQLSPKTFASKMYGLCGICDENGANDFMLRDGTVTTDWKRLVQDWTVQQPGKTCQPVPEEECPISSTSHCQVLLSALFAECHKVFAPATFYAMCQQDSCHLEQVCEAIASYAHLCRTNGVCVDWRTTDFCAMSCPPSLVYNHCEHGCPRHCEGNSSSCGNHPSEGCFCPSHQVMLEGSCVPEEACTHCVGEDGVRHQFLETWVPDHQPCQICTCLSGRKVNCTSHPCPTVRVPTCGPCEVARLHQNADQCCPEYECVCDLVSCDLPPVPHCEGGLQPTLTNPGECRPNFTCACRKEECRRESPPSCPPHRTPTLRKTQCCDEYECACNCVNSTVTCPLGYLSSAITNDCGCTTITCLPDKVCVHRGTVYPIGQLWEEGCDICTCTDMEDAVMGLRVAQCSQKPCEESCQLGFTYVLHEGECCGRCLPSACEVVIGSPRGDSQSYWKDVGSHWASPENPCLINECVRVKEEVFVQQRNVSCPQLDVPTCPVGFQLSCASSECCPTCHCEPVQACMLNGTIIGPGKTMMIDVCTTCHCTAQVGIISGFKLECSKTTCTACPEGYKKENIPGECCWRCLPVACTIQLRGGQIMTLQRDEMFQDGCDSHFCKVNERGEYIWEKRVTGCPPFDEHKCLAQGGKIMKIPGTCCDTCEEPDCKDIIARLQYVKVGSCKSEEEVDIHYCQGKCASKALYSIETEDVQDQCSCCSPTRTEPMQVPLRCTNGSIVYHEVLNAMQCRCSPRKCSK

SEQ ID NO: 101 - protein, 2811 aa, Nomascus leucogenys
MIPARFAGVLLALALILPGTLCAEGTRGRSSMARCSLFGSDFINTFDGSMYSFAGYCSYLLAGDCQKRSFSIIGDFQNGKRVSLSVYLGEFFDIHLFVNGTVTQGDQRVSMPYASKGLYLETEAGYSKLSGETYGFVARIDGSGNFQVLLSDRYFNKTCGLCGNFNIFAEDDFTTQEGTLTSDPYDFANSWALSSGEQWCERASPPSSSCNISSGEMQKDLWEQCQLLSTSVFARCHPLVPEPFVALCEKTLCECAGGLECTCPAFLEYARTCAQEGMVLYGWTDHSACSPVCPAGMEYKQCVSPCARTCQSLHINEVCQERCVDGCSCPEGQLLDEGLCVESTECPCMHSGKRYPPGASLSRDCNTCICRNSQWICSNEECPGECLVTGQSHFKSFDNRYFTFSGICQYLLARDCQDHSFSIVIETVQCADDPDAVCTRSVTIRLPGLHNSLVKLKHGGGVAMDGQDVQLPLLKGDLRIQHTVTASVHLSHGEDLQLDWDGRGRLLVKLSPVYAGKTCGLCGNYNGNQGDDFITPSGLAEPRVEDFGNAWKLHGNCQDLQKQHSDPCALNPRMTRFSEEACAVLTSPTFEACHRAVSPLPYLRNCRYDVCSCSDGRECLCGALASYAAACAGRGVRVAWRQPDRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGETVKIGCNTCVCRDRKWNCTDHVCDATCSTIGMAHYLTFDGLKYMFPGECQYVLVQDYCGSNPGTFRVLVGNEGCSHPSVKCKKRVTILVEGGEIELFDGEANVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEVAGRRFAPGKKVTLNPSDPEHCQICHCDGVNLTCEACQEPGGLVVPPTDAPVSPTTPYVEDTWEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLVEKQAPENKAFVLSGVDELEQQRDEIVSYLCDLAPEAPPPTLPPNMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALQYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPASDCSQPLDVIFLLDGSSSFPASYFDEMKSFAKAFISKANIGPHLTQVSVLQYGSITTIDVPWNVAPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNMVKLQRIEDLPTMVTLGNSFLHKLCSGFVRICMDEDGNEKRPGDVWTLPDQCHTVTCQPDGQTLLKSHRVNCDRGPRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGTIMHEVRFNHLGHIFTFTPQNNEFQLQLSPKTFASKTYGLCGICDENGANDFMLRDGTVTTDWKTLVQEWTVQQPGHTCHPIPEEQCLVPDSSHCQILLLPLFAECHKVLAPATFYAICQQDSCHQEQVCGVIASYAHLCRTNGVCVDWRTPDFCAMSCPPSLVYNHCEHGCPRHCDGNVSSCGDHPSEGCFCPPNKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCEGGLQPTLTNPGECRPNFTCACRKEECERVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSFWKSVGSQWASPENPCLINECVRVKEEVFVQQRNVSCPQLEVPACPSGFQLSCKTSVCCPSCRCERVEACMLNGTIIGPGKSVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNAMECKCSPRKCSK

SEQ ID NO: 102 - protein, 3626 aa, Cricetulus griseus
MARCSLFGDDFINTFDETMYSFAGGCSYLLAGDCQKHSFSIIGNYQDGKRVSLSVYLGEFFDIHLFANGTVMQGYQSINMPYASKGLHLETEAGYYKLSSEAYGFVARIDGDGNFQVLMSDRHFNKTCGLCGDFNIFAEDDFRTQEGALTSDPYDFANSWALSGEEQRCKRASPPSSHCNSSSGDMQKAMWEQCQLLKSASVFARCHPLVDPEPFVALCEKTLCTCTTGPECSCPALLEYARTCAQEGMVLYGWTDHSACQGELLDEDRCVQSSECSCVHAGKRYPPGTSLSQDCNTCICRNSLWICSNEECPGECLVTGQSHFKSFDNRYFTFSGICQYLLARDCQDHSFSIVIETVQCADDPDAVCTRSVTLRLSALHNSLVKLKHGGGVAIDGQDVQIPFLQGDLRIQHTVMASVRLSYEEDLQMDWDGRGRLLVKLSPVYSGKTCGLCGNYNGNKGDDFLTPAGLVEPLVVDFGNAWKLQGDCPDLHMQHSDPCSLNPRLTRFAEEACALLTSSKFEACHHAISPLPYLQNCRYDVCSCSDGRDCLCSAVANYAAACARKGVHIGWREPDFCALGCPQGQVYLQCGNSCNLTCRSLSYPDEECNEVCLEGCFCPPGLYQDERGNCVPKAQCPCYYDGELFQPADIFSDHHTMCYCEDGFMHCTTSVGPGSLLPDIVLSSPLSHRSKRSLSCRPPMVKLVCPADNPRAQGLECAKTCQNYDLECMSLGCVSGCLCPPGMVRHENKCVALERCPCFHQGQEYAPGDKVKIDCNTCVCRDRRWNCTDHVCDATCSAIGMANYITFDGLKYLFPGECQYVLVQDYCGDNPGTFRILVGNEGCSYPSVTCKKRVTILVEGGEIELSDGEVNVKKPLKDESHFEVVESGRYVLLLLGPALSVVWDHHLSVSVVLKRTYQEQVCGLCGNFDGIQNNDFTSSSLQVEEDPVDFGNSWKVSSQCANTRKLSLDVPPATCHNNIMKQTMVDSSCRILTSDIFQGCNRLVDPEPYLDICIYDTCSCESIGDCACFCDTIAAYAHVCAQHGQVVPWRTPTLCPQSCEARNVQENGYECEWRYNSCAPACPVTCQHPEPLACPVQCVEGCHAHCPPGRILDELLQTCVDPQDCPVCEVAGRRLAPGKRITLSPDDPTHCQNCHCDGVNLTCEACGEPGGLVVPPTDGPVSSTTPYVEETPEPPLHSFYCSKLLDLVFLLDGSSRLSEAEFEVLKAFVVGTMERLHISQKRIRVAVVEYHDGSHAYIDLKDRKRPSELRRIASQVRYAGSQVASTSEVLKYTLFQIFGRIDRPEASRIVLLLTASQEPPRLARNLVRYVQGLKQKKITVIPVGIGPHASLRQVRLIEKQAPENKAFLLSGVDELEQRRDEIISYLCDLAPEPRAPTKRPQVAQITTSPGTLGISSPGPKRKSMVLDVVFVLEGSDKVGEANFNKSKEFLEEVIRRMDVSQDGTHISVLQYSYTATVEYTFNEAQSKEDVLRHVREIRYHGGNRTNTGQALQYLSEYSFSPSQGDREQAPNLVYLVTGNPASDEIKRLPGDIQVVPIGVGPRANTQELERIGWPNAPIFIRDFETLPREAPDLVLQRCCSREGLQLPTLSPTPDCSQPLDVVLLLDGSSSLPESYFDMMKSFAKAFISKANIGPHLTQVSVLQYGSINTIDVPWNVAQEKAHLLSLVDLMQREGGPSKIGDALAFAVRYVTSQIHGARPGASKAVVILILGTSLDSVDTAADAARSNRVAVFPIGVGDRYDEAQLRILAGPGASSNVVKLQQVEDLPTIVTPGNSFFHRLCSGFSGVCVDEDGNEKRPGEVWTLPDQCHTVTCLPNGQTLLQSHRVNCDHGPRPSCSNSQSPVRVEETCGCRWTCPCVCTGSSTRHIITFDGQNFKLTGNCSYVLFHNKEQDLEVILHNGACSPGARQACMKSIEIKHGGLSVELHSDMEMSVNGRLVPAPYVGGDMEVSVYGAIMYEVRFNHLGHILTFTPQNNEFQLQLSPKTFASKMYGLCGICDENGANDFMLRDGTVTTDWKRLIQEWTVQQPGYPCQPVPEEQCPVSDSSHCQVLLSTLFAECHKVLAPATFHAICQQDSCHQERVCEVIASYAHLCRTNGVCVDWRTTDFCAMSCPASLVYNHCEHGCPRHCDGNTTSSCGDHPSEGCFCPQHQVMLEGSCVPEEACTQCIGEDGVRHQFLETWVPDHQPCQICVCLSGRKANCTAQPCPTARAPTCGPCEVARLKESANRCCPEYASCRKEECKRVSPPSCPPHRTPTLRKTQCCDEYECACSCVNSTLSCPLGYLASTTTNDCGCTTTTCLPDKVCVHRGTIYPVGQFWEEGCDTCTCTDMEDTVMGLRVAQCSQKPCEDSCQPVGSRWAAPENPCLINECVRVEEAVFVQQRNISCPQLAVPTCPTGFQLSCETSECCPSCRCEPMEACLLNGTIIGRDETLQDGCDSHFCKVNERGEYIWEKRVTGCPPFDERRCLAEGGKIVKIPGTCCDTCEEPDCKDIVAKLQYVKVGDCKSQEEVDIHYCQGKCASKAVYSIDIEDVQQHCSCCGPSRTEPMRVPLHCTNGSVVYHEVINAMQCRGGPLNWAPAARVDDVVEKHGKSPMDLRDIPLLPGSPRRLSSRTVARGGQGPKQYLRVPSPRAPGQRDSSSGHSGQISRRECSHDNSVINNYLDANEPSSEARLSRMHFHDNQRKVDYVLAYHYRKRGAHQGHGSPGHSLAVISNGETGKERHAGGPGDIELGPLDALEEERRGQRDEFEHNLMAAGLELEKDLEMYEIKAGGSIAKKFSAILQTLSSPLQPRVPEHSNNRMKNLSYPFSREKMYLYNIQEKDTFFDNATRSRIVHEILKRTACSRANNTMGINSLIANNIYEAAYPLHDGEYDSPGDDMNDRKLLYQEWARYGVFYKFQPIDLIRKYFGEKIGLYFAWLGLYTSFLIPSSVIGVIVFLYGCATIEEDIPSKEMCDHQNAFTMCPLCDKSCDYWNLSSACGTARASHLFDNPATVFFSIFMALWATMFLENWKRLQMRLGYFWDLTGIEEEEEHSRPEYETKVREKLLKESGKSVVQKLDANSPVDDEDDEDKLTWKDRFPGYLMNFASILFMIALTFSIVFGVIVYRITTAAALSLSKATRSNVRATVTATAVIINLVVILILDEIYGAVAKWLTKIEVPKTEQTFEERLILKAFLLKFVNAYSPIFYVAFFKGRFVGRPGSYVYVFDGYRMEEAKPAWSDVSVLPLLQCAPGGCLMELCIQLSIIMLGKQLIQNNIFEIGVPKLKKLFRKLKDETEPGESDPDHSKRPEQWDLDYSLEPYTGLTPEYMEMIIQFGFVTLFVASFPLAPVFALLNNVIEVRLDAKKFVTELRRPDAVRTKDIGIWFDILSGIGKFSVIINAFVIAVTSDFIPRLVYQYSYSHNGTLHGFVNHTLSFFNVSQLKEGTQPENSQFDQEVQFCRFKDYREPPWAPNPYEFSKQYWSVLSARLAFVIIFQHQDGHSEGERVDSGELVSTCDLMYHTTQPSLTIHISSLIRQNLVMFLSVLVDWMIPDIPTDISDQIKKEKSLLVDFFLKEEHEKVKLADEPTQRSQGGGDRSRRSRAASSAPSGRSQPGSIASSGSQHTNV

SEQ ID NO: 103 - protein, 2813 aa, Pan troglodytes
MIPARFARVLLALALILPGTLCAEGTRGRSSMARCSLFGNDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPAFLEYARTCAQEGMVLYGWTDHSACSPVCPAGMEYKQCVSPCARTCQSLHINEMCQERCVDGCSCPEGQLLDEGLCVESTECPCVHSGKRYPPGASLSRDCNTCICRNSQWICSNEECPGECLVTGQSHFKSFDNRYFTFSGICQYLLARDCQDHSFSIVIETVQCADDRDAVCTRSVTVRLRGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVSVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLQAEGLECAKTCQNYDLECMSMGCVSGCLCPPGMVRHGNRCVALERCPCFHQGKEYAPGETVKIGCNTCVCRDRKWNCTDHVCDATCSMIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPKDCPVCEVAGRRFASGKKVTLNPSDPEHCQICHCDGVNLTCEACQEPGGLVVPPTDGPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSGVDELEQQRDEIVSYLCDLAPEAPPPTLPPHVAQVTVGLGLLGLSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFESLPREAPDLVLQRCCSGEGLQIPTLSPASDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPNSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDVVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLNCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 104 - protein, 2815 aa, Myotis davidii
MIPARLARVLLALVLTLPGTLCAEGSLGRSPMARCSLFGDDFISTFDESMYSFAGDCSYLLAGDCQKHSFSLIGDLQNGKRVSLSVYLGEFFDIHLFVNGTVLQGDQSVSMPYASKGLYLETEAGYYKLSSEAYGFVARIDGSGSFQILLSDRYFNKTCGLCGNFNIFAEDDFRTQEGSMTSDPYDFANSWAMSSGEQRCKRASPSSSSCNASEEMQGLWEQCQLLKRDSVFTRCHPLVDPEPFVALCESTLCTCTQGLRCPCAALLEYARACAHQGMVLYGWTEHSECQPACPAGMEYKECVSPCTRTCQSLKINEVCQEQCVDGCSCPEGQLLDEGRCVESTECSCVHSGKRYPPGASLSRDCNTCICRNSLWICSNEECPGECIITGQSHFKSFDDRYFTFSGVCQYLLARDCQDHSFSIVIETVQCADDPDAVCTRSVTARLPSLHNSLVKLKHGGGIAIDGQDVQLPLLQGDLRIQHTVMAFVRLSYGEDLQMDWDGRGRLLVKLSPVYAGRTCGLCGNFNGNKGDDFRTPAGLVEPLVEDFGNAWKLHADCADLQQQHSDPCKLNPRLAKFAEEACSLLTSPKFEACHHAVGPLPYLQNCHYDVCSCSDGRDCLCSAVANYAAACGRKGVHVAWREPSFCALSCPQGQVYLQCGTPCNMTCRSLSYPDEECTELCLEGCFCPPGLYLDERGDCVPKSQCPCYYDGEIFQPEDIFSDHHTMCYCEDGFMHCSMSGAPGSLLPQHIVLSGPLGPLSHRSKRSLSCRPPMVKLVCPADNPRAEGLECAKTCQNYDLECMSTGCVSGCLCPPGMVRHENRCVALERCPCFHQGKEYAPGETVKINCNTCVCRDRKWNCTDHVCDATCSTFGVAHYLTFDGLKYMFPGECQYVLVQDYCGSNPGTFRILVGNEGCGYPSVKCKKRVTILVEGGEIELFDGEVNVKRPMKDETHFEVVESGRYIILLLGKALSVVWDHHLSISVVLKQTYQEQVCGLCGNFDGVQNNDFTGSNLQVEEDPVDFGNSWKVSPQCADTRKVPLDSPPATCHNNIMKQSMVDSSCRILTSDLFQDCNKLVDPEPFLDVCIYDTCSCESIGDCACFCDTIAAYAHVCAQHGKVVTWRTATLCPQNCEEKNIRENGYECEWRYNSCAPACPITCQHPEPLACPVQCVEGCHAHCPPGKILDELLQTCVDPGDCPVCEVSGRRLAPGKKVTLNPGDPEHCQICHCDGVNLTCEACREPEGLEAPPTEGPVSPTTPYVEDTPEPPLHDFFCSKLLDLVFLLDGSSKLSPAEFEVLKVFVVDMMERLHISQKRIRVALVEYHEGSHAYIQLRDRKRPSEMRRLASQVKYAGSAVASTSEVLKYTLFQIFGKIDRPEASRIALLLTASQEPQKLGRNLVRYVQGLKKKKVIVVPVGIGPHANLKQIRLIEKQAPENKAFVLSSVDELEQQRDEIISYLCDLAPEAPAPTQPPPMAQVTVGPEHLGVSTLGPKRNSMVLDVVFVLEGSDQIGEANFNKSKEFMEEVIRRMNVGQESIHVSVLQYSYTVIEETTFRETQSKQDVLQRVREIRYQGGNSTNTGLALQYVSEHTFSASLGDREQAPNLVYMVTANPASDVIKRMPGDIQVVPIGVGPHANVPELERIGWPNDPILIQDFEMLPREAPDLVLQRCCSGEVLQIPTLSPAPDCSQPLDVILLLDGSSGFPASYFDEMKSFAKAFISKANVGPQLTHVSVLQYGSITTVDVPWNMAQEKTQLLGAVDQMQQEGGPSQIGDALGFAVRYITSAGHGARPGASKAVVILVMGDSTDSVAAAAEAARSNRVTVFPIGIGDRYDPAQLRTLAGPGASSNVVKLQHIEDLPTIVTLGNSFLHKLCSGYIGVCMDEDGNEKRPGDVWTLPDQCHTVTCLPDGQTLLNSHRVNCDRGPRPSCPNSQSPVRVEETCGCRWTCPCVCMGSSTRHIVTFDGQNFKLTGSCSYVLFQNKEQDLELILHNGACSPGARHACMKSIEVKHNGLSVELHSDMEVGVNGILVSVPYMGGDMEVSIYGAIMYEIRFNRLGHIFTFTPQNNEFQLQLSPKTFASKMYGLCGICDENGANDFMLRDGTVTTDWKRLVQDWTVQQPGRTCQPVPEEECPISSTSHCQVLLSALFAECHKVFAPATFYAMCQQDSCHLEQVCEAIASYAHLCRTNGVCVDWRTTDFCAMSCPPSLVYNHCEHGCPRHCEGNSSSCGNHPSEGCFCPSHQVMLEGSCVPEEACTQCVSEDGVRHQFLETWVPDHQPCQICTCLSGRKVNCTSHPCPTARVPTCGPCEVARLHQNADQCCPEYECVCDPVSCDLPPVPHCEGGLQPTLTNPGECRPNFICACRKEECRRESPPSCPPHRTPTLRKTQCCDEYECACNCVNSTVTCPLGYLSSVITNDCGCTTITCLPDKVCVHRGTVYPIGQLWEEGCDICTCTDMEDAVMGLRVAQCSQKPCEESCQLGFTYVLHEGECCGRCLPSACEVVIGSPRGDSQTYWKDVGSHWASPENPCLINECVRVKEEVFVQQRNVSCPQLDVPTCPVGFQLSCASSECCPTCHCEPVQACMLNGTIIGPGKSMMIDVCTTCHCTAQVGIISGFKLECSKTTCTACPEGYKEENIPGECCWRCLPVACTIQLRGGQIMTLQRDEMFQDGCDSHFCKVNERGEYIWEKRVTGCPPFDEHKCLAQGGKIMKIPGTCCDTCEEPDCKDITARLQYVKVGSCKSEEEVDIHYCQGKCASKALYSIETEDVQDQCSCCSPTRTEPMQVPLRCTNGSIVYHEVLNAMQCRCSPRKCSK

SEQ ID NO: 105 - protein, 2715 aa, Homo sapiens [sequence omitted]

SEQ ID NO: 106 - protein, 2813 aa, Homo sapiens; identical to SEQ ID NO: 73

SEQ ID NO: 107 - protein, 2813 aa, Mus musculus
MNPFRYEICLLVLALTWPGALCTEKPRDRPSTARCSLFGDDFINTFDETMYSFAGGCSYLLAGDCQKRSFSILGNFQDGKRMSLSVYLGEFFDIHLFANGTVMQGDQSISMPYASQGLYLEREAGYYKLSSETFGFAARIDGNGNFQVLMSDRHFNKTCGLCGDFNIFAEDDFRTQEGTLTSDPYDFANSWALSSEEQRCKRASPPSRNCESSSGDMHQAMWEQCQLLKTASVFARCHPLVDPESFVALCEKTLCTCATGPECACPVLLEYARTCAQEGMVLYGWTDHSACRPACPAGMEYKECVSPCPRTCQSLSINEVCQQQCVDGCSCPEGELLDEDRCVQSSDCPCVHAGKRYPPGTSLSQDCNTCICRNSLWICSNEECPGECLVTGQSHFKSFDNRYFTFSGICQYLLARDCEDHSFSIVIETMQCADDPDAVCTRSVSVRLSALHNSLVKLKHGGAVGIDGQDVQLPFLQGDLRIQHTVMASVRLSYAEDLQMDWDGRGRLLVKLSPVYSGKTCGLCGNYNGNKGDDFLTPAGLVEPLVVDFGNAWKLQGDCSDLRRQHSDPCSLNPRLTRFAEEACALLTSSKFEACHHAVSPLPYLQNCRYDVCSCSDSRDCLCNAVANYAAECARKGVHIGWREPGFCALGCPQGQVYLQCGNSCNLTCRSLSLPDEECSEVCLEGCYCPPGLYQDERGDCVPKAQCPCYYDGELFQPADIFSDHHTMCYCEDGFMHCTTSGTLGSLLPDTVLSSPLSHRSKRSLSCRPPMVKLVCPADNPRAQGLECAKTCQNYDLECMSLGCVSGCLCPPGMVRHENKCVALERCPCFHQGAEYAPGDTVKIGCNTCVCRERKWNCTNHVCDATCSAIGMAHYLTFDGLKYLFPGECQYVLVQDYCGSNPGTFQILVGNEGCSYPSVKCRKRVTILVDGGELELFDGEVNVKRPLRDESHFEVVESGRYVILLLGQALSVVWDHHLSISVVLKHTYQEQVCGLCGNFDGIQNNDFTTSSLQVEEDPVNFGNSWKVSSQCADTRKLSLDVSPATCHNNIMKQTMVDSACRILTSDVFQGCNRLVDPEPYLDICIYDTCSCESIGDCACFCDTIAAYAHVCAQHGQVVAWRTPTLCPQSCEEKNVRENGYECEWRYNSCAPACPVTCQHPEPLACPVQCVEGCHAHCPPGRILDELLQTCVDPQDCPVCEVAGRRLAPGKKITLSPDDPAHCQNCHCDGVNLTCEACQEPGGLVAPPTDAPVSSTTPYVEDTPEPPLHNFYCSKLLDLVFLLDGSSMLSEAEFEVLKAFVVGMMERLHISQKRIRVAVVEYHDGSRAYLELKARKRPSELRRITSQIKYTGSQVASTSEVLKYTLFQIFGKIDRPEASHITLLLTASQEPPRMARNLVRYVQGLKKKKVIVIPVGIGPHASLKQIRLIEKQAPENKAFLLSGVDELEQRRDEIVSYLCDLAPEAPAPTQPPQVAHVTVSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPTLPPLPDCSQPLDVVLLLDGSSSLPESSFDKMKSFAKAFISKANIGPHLTQVSVIQYGSINTIDVPWNVVQEKAHLQSLVDLMQQEGGPSQIGDALAFAVRYVTSQIHGARPGASKAVVIIIMDTSLDPVDTAADAARSNRVAVFPVGVGDRYDEAQLRILAGPGASSNVVKLQQVEDLSTMATLGNSFFHKLCSGFSGVCVDEDGNEKRPGDVWTLPDQCHTVTCLANGQTLLQSHRVNCDHGPRPSCANSQSPVRVEETCGCRWTCPCVCTGSSTRHIVTFDGQNFKLTGSCSYVIFQNKEQDLEVLLHNGACSPGAKQACMKSIEIKHAGVSAELHSNMEMAVDGRLVLAPYVGENMEVSIYGAIMYEVRFTHLGHILTYTPQNNEFQLQLSPKTFASKMHGLCGICDENGANDFTLRDGTVTTDWKRLVQEWTVQQPGYTCQAVPEEQCPVSDSSHCQVLLSASFAECHKVIAPATFHTICQQDSCHQERVCEVIASYAHLCRTSGVCVDWRTTDFCAMSCPPSLVYNHCERGCPRHCDGNTSFCGDHPSEGCFCPQHQVFLEGSCVPEEACTQCVGEDGVRHQFLETWVPDHQPCQICMCLSGRKINCTAQPCPTARAPTCGPCEVARLKQSTNLCCPEYECVCDLFNCNLPPVPPCEGGLQPTLTNPGECRPTFTCACRKEECKRVSPPSCPPHRTPTLRKTQCCDEYECACSCVNSTLSCPLGYLASATTNDCGCTTTTCLPDKVCVHRGTVYPVGQFWEEGCDTCTCTDMEDTVVGLRVVQCSQRPCEDSCQPGFSYVLHEGECCGRCLPSACKVVAGSLRGDSHSSWKSVGSRWAVPENPCLVNECVRVEDAVFVQQRNISCPQLAVPTCPTGFQLNCETSECCPSCHCEPVEACLLNGTIIGPGKSVMVDLCTTCRCIVQTDAISRFKLECRKTTCEACPMGYREEKSQGECCGRCLPTACTIQLRGGQIMTLKQDETFQDGCDSHLCRVNERGEYIWEKRVTGCPPFDEHKCLAEGGKIVKIPGTCCDTCEEPDCKDITAKVQYIKVGDCKSQEEVDIHYCQGKCASKAVYSIDIEDVQEQCSCCLPSRTEPMRVPLHCTNGSVVYHEVINAMQCRCSPRNCSK

SEQ ID NO: 108 - protein, 2813 aa, Mus musculus
MNPFRYEICLLVLALTWPGTLCTEKPRDRPSTARCSLFGDDFINTFDETMYSFAGGCSYLLAGDCQKRSFSILGNFQDGKRMSLSVYLGEFFDIHLFANGTVMQGDQSISMPYASQGLYLELEAGYYKLSSETFGFAARIDGNGNFQVLMSDRHFNKTCGLCGDFNIFAEDDFRTQEGTLTSDPYDFANSWALSSEEQRCKRASPPSRNCESSSGDMHQAMWEQCQLLKTASVFARCHPLVDPESFVALCEKILCTCATGPECACPVLLEYARTCAQEGMVLYGWTDHSACRPACPAGMEYKECVSPCPRTCQSLSINEVCQQQCVDGCSCPEGELLDEDRCVQSSDCPCVHAGKRYPPGTSLSQDCNTCICRNSLWICSNEECPGECLVTGQSHFKSFDNRYFTFSGICQYLLARDCEDHTFSIVIETMQCADDPDAVCTRSVSVRLSALHNSLVKLKHGGAVGIDGQDVQLPFLQGDLRIQHTVMASVRLSYAEDLQMDWDGRGRLLVKLSPVYSGKTCGLCGNYNGNKGDDFLTPAGLVEPLVVDFGNAWKLQGDCSDLRRQHSDPCSLNPRLTRFAEEACALLTSSKFEACHHAVSPLPYLQNCRYDVCSCSDSRDCLCNAVANYAAECARKGVHIGWREPGFCALGCPQGQVYLQCGNSCNLTCRSLSLPDEECSEVCLEGCYCPPGLYQDERGDCVPKAQCPCYYDGELFQPADIFSDHHTMCYCEDGFMHCTTSGTLGSLLPDTVLSSPLSHRSKRSLSCRPPMVKLVCPADNPRAQGLECAKTCQNYDLECMSLGCVSGCLCPPGMVRHENKCVALERCPCFHQGAEYAPGDTVKIGCNTCVCRERKWNCTNHVCDATCSAIGMAHYLTFDGLKYLFPGECQYVLVQDYCGSNPGTFQILVGNEGCSYPSVKCRKRVTILVDGGELELFDGEVNVKRPLRDESHFEVVESGRYVILLLGQALSVVWDHHLSISVVLKHTYQEQVCGLCGNFDGIQNNDFTTSSLQVEEDPVNFGNSWKVSSQCADTRKLSLDVSPATCHNNIMKQTMVDSACRILTSDVFQGCNRLVDPEPYLDICIYDTCSCESIGDCACFCDTIAAYAHVCAQHGQVVAWRTPTLCPQSCEEKNVRENGYECEWRYNSCAPACPVTCQHPEPLACPVQCVEGCHAHCPPGRILDELLQTCVDPQDCPVCEVAGRRLAPGKKITLSPDDPAHCQNCHCDGVNLTCEACQEPGGLVAPPTDAPVSSTTPYVEDTPEPPLHNFYCSKLLDLVFLLDGSSMLSEAEFEVLKAFVVGMMERLHISQKRIRVAVVEYHDGSRAYLELKARKRPSELRRITSQIKYTGSQVASTSEVLKYTLFQIFGKIDRPEASHITLLLTASQEPPRMARNLVRYVQGLKKKKVIVIPVGIGPHASLKQIRLIEKQAPENKAFLLSGVDELEQRRDEIVSYLCDLAPEAPAPTQPPQVAHVTVSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPTLPPLPDCSQPLDVVLLLDGSSSLPESSFDKMKSFAKAFISKANIGPHLTQVSVIQYGSINTIDVPWNVVQEKAHLQSLVDLMQQEGGPSQIGDALAFAVRYVTSQIHGARPGASKAVVIIIMDTSLDPVDTAADAARSNRVAVFPVGVGDRYDEAQLRILAGPGASSNVVKLQQVEDLSTMATLGNSFFHKLCSGFSGVCVDEDGNEKRPGDVWTLPDQCHTVTCLANGQTLLQSHRVNCDHGPRPSCANSQSPVRVEETCGCRWTCPCVCTGSSTRHIVTFDGQNFKLTGSCSYVIFQNKEQDLEVLLHNGACSPGAKQACMKSIEIKHAGVSAELHSNMEMAVDGRLVLAPYVGENMEVSIYGAIMYEVRFTHLGHILTYTPQNNEFQLQLSPKTFASKMHGLCGICDENGANDFTLRDGTVTTDWKRLVQEWTVQQPGYTCQAVPEEQCPVSDSSHCQVLLSASFAECHKVIAPATFHTICQQDSCHQERVCEVIASYAHLCRTSGVCVDWRTTDFCAMSCPPSLVYNHCERGCPRHCDGNTSFCGDHPSEGCFCPQHQVFLEGSCVPEEACTQCVGEDGVRHQFLETWVPDHQPCQICMCLSGRKINCTAQPCPTARAPTCGPCEVARLKQSTNLCCPEYECVCDLFNCNLPPVPPCEGGLQPTLTNPGECRPTFTCACRKEECKRVSPPSCPPHRTPTLRKTQCCDEYECACSCVNSTLSCPLGYLASATTNDCGCTTTTCLPDKVCVHRGTVYPVGQFWEEGCDTCTCTDMEDTVVGLRVVQCSQRPCEDSCQPGFSYVLHEGECCGRCLPSACKVVAGSLRGDSHSSWKSVGSRWAVPENPCLVNECVRVEDAVFVQQRNISCPQLAVPTCPTGFQLNCETSECCPSCHCEPVEACLLNGTIIGPGKSVMVDLCTTCRCIVQTDAISRFKLECRKTTCEACPMGYREEKSQGECCGRCLPTACTIQLRGGRIMTLKQDETFQDGCDSHLCRVNERGEYIWEKRVTGCPPFDEHKCLAEGGKIVKIPGTCCDTCEEPDCKDITAKVQYIKVGDCKSQEEVDIHYCQGKCASKAVYSIDIEDVQEQCSCCLPSRTEPMRVPLHCTNGSVVYHEVINAMQCRCSPRNCSK

SEQ ID NO: 109 - protein, 2813 aa, Mus musculus
MNPFRYEICLLVLALTWPGTLCTEKPRDRPSTARCSLFGDDFINTFDETMYSFAGGCSYLLAGDCQKRSFSILGNFQDGKRMSLSVYLGEFFDIHLFANGTVMQGDQSISMPYASQGLYLELEAGYYKLSSETFGFAARIDGNGNFQVLMSDRHFNKTCGLCGDFNIFAEDDFRTQEGTLTSDPYDFANSWALSSEEQRCKRASPPSRNCESSSGDMHQAMWEQCQLLKTASVFARCHPLVDPESFVALCEKILCTCATGPECACPVLLEYARTCAQEGMVLYGWTDHSACRPACPAGMEYKECVSPCPRTCQSLSINEVCQQQCVDGCSCPEGELLDEDRCVQSSDCPCVHAGKRYPPGTSLSQDCNTCICRNSLWICSNEECPGECLVTGQSHFKSFDNRYFTFSGICQYLLARDCEDHTFSIVIETMQCADDPDAVCTRSVSVRLSALHNSLVKLKHGGAVGIDGQDVQLPFLQGDLRIQHTVMASVRLSYAEDLQMDWDGRGRLLVKLSPVYSGKTCGLCGNYNGNKGDDFLTPAGLVEPLVVDFGNAWKLQGDCSDLRRQHSDPCSLNPRLTRFAEEACALLTSSKFEACHHAVSPLPYLQNCRYDVCSCSDSRDCLCNAVANYAAECARKGVHIGWREPGFCALGCPQGQVYLQCGNSCNLTCRSLSLPDEECSEVCLEGCYCPPGLYQDERGDCVPKAQCPCYYDGELFQPADIFSDHHTMCYCEDGFMHCTTSGTLGSLLPDTVLSSPLSHRSKRSLSCRPPMVKLVCPADNPRAQGLECAKTCQNYDLERMSLGCVSGCLCPPGMVRHENKCVALERCPCFHQGAEYAPGDTVKIGCNTCVCRERKWNCTNHVCDATRSAIGMAHYLTFDGLKYLFPGECQYVLVYDYCGSNPGTFQILVGNEGCSYPSVKCRKRVTILVDGGELELFDGEVNVKRPLRDESHFEVVESGRYVILLLGQALSVVWDHHLSISVVLKHTYQEQVCGLCGNFDGIQNNDSTTSSLQVEEDPVNFGNSWKVSSQCADTRKLSLDVSPATCHNNIMKQTMVDSACRILTSDVFQGCNRLVDPEPYLDICIYDTCSCESIGDCACFCDTIAAYAHVCAQHGQVVAWRTPTLCPQSCEEKNVRENGYECEWRYNSCAPACPVTCQHPEPLACPVQCVEGCHAHCPPGRILDELLQTCVDPQDCPVCEVAGRRLAPGKKITLSPDDPAHCQNCHCDGVNLTCEACQEPGGLVAPPTDAPVSSTTPYVEDTPEPPLHNFYCSKLLDLVFLLDGSSMLSEAEFEVLKAFVVGMMERLHISQKRIRVAVVEYHDGSRAYLELKARKRPSELRRITSQIKYTGSQVASTSEVLKYTLFQIFGKIDRPEASHITLLLTASQEPPRMARNLVRYVQGLKKKKVIVIPVGIGPHASLKQIRLIEKQAPENKAFLLSGVDELEQRRDEIVSYLCDLAPEAPAPTQPPQVAHVTVSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPTLPPLPDCSQPLDVVLLLDGSSSLPESSFDKMKSFAKAFISKANIGPHLTQVSVIQYGSINTIDVPWNVVQEKAHLQSLVDLMQQEGGPSQIGDALAFAVRYVTSQIHGARPGASKAVVIIIMDTSLDPVDTAADAARSNRVAVFPVGVGDRYDEAQLRILAGPGASSNVVKLQQVEDLSTMATLGNSFFHKLCSGFSGVCVDEDGNEKRPGDVWTLPDQCHTVTCLANGQTLLQSHRVNCDHGPRPSCANSQSPVRVEETCGCRWTCPCVCTGSSTRHIVTFDGQNFKLTGSCSYVIFQNKEQDLEVLLHNGACSPGAKQACMKSIEIKHAGVSAELHSNMEMAVDGRLVLAPYVGENMEVSIYGAIMYEVRFTHLGHILTYTPQNNEFQLQLSPKTFASKMHGLCGICDENGANDFTLRDGTVTTDWKRLVQEWTVQQPGYTCQAVPEEQCPVSDSSHCQVLLSASFAECHKVIAPATFHTICQQDSCHQERVCEVIASYAHLCRTSGVCVDWRTTDFCAMSCPPSLVYNHCERGCPRHCDGNTSFCGDHPSEGCFCPQHQVFLEGSCVPEEACTQCVGEDGVRHQFLETWVPDHQPCQICMCLSGRKINCTAQPCPTARAPTCGPCEVARLKQSTNLCCPEYECVCDLFNCNLPPVPPCEGGLQPTLTNPGECRPTFTCDCRKEECKRVSPPSCPPHRTPTLRKTQCCDEYECACSCVNSTLSCPLGYLASATTNDCGCTTTTCLPDKVCVHRGTVYPVGQFWEEGCDTCTCTDMEDTVVGLRVVQCSQRPCEDSCQPGFSYVLHEGECCGRCLPSACKVVAGSLRGDSHSSWKSVGSRWAVPENPCLVNECVRVEDAVFVQQRNISCPQLAVPTCPTGFQLNCETSECCPSCHCEPVEACLLNGTIIGPGKSVMVDLCTTCRCIVQTDAISRFKLECRKTTCEACPMGYREEKSQGECCGRCLPTACTIQLRGGRIMTLKQDETFQDGCDSHLCRVNERGEYIWEKRVTGCPPFDEHKCLAEGGKIVKIPGTCCDTCEEPDCKDITAKVQYIKVGDCKSQEEVDIHYCQGKCASKAVYSIDIEDVQEQCSCCLPSRTEPMRVPLHCTNGSVVYHEVINAMQCRCSPRNCSK

SEQ ID NO: 110 - protein, 2945 aa, Myotis brandtii
MPVADGRYSGVHGGVKHCARLAYPFLVLMMELKQWPGEPEVAGPRGHANRAWKFLDFKGVVWAREAGSSKRGGPKMVSAAPGPVSSKPGQSCGNPISAAAIGEHGLGLAAAVWLFPKGPWRYVQPHLQEKMIPARLARVLLALVLTLPGTLCAEGSLGRSPMARCSLFGDDFISTFDESMYSFAGDCSYLLAGDCQKHSFSLIGDFQNGKRVSLSVYLGEFFDIHLFVNGTVLQGDQSVSMPYASKGLYLETEAGYYKLSSEAYGFAARIDGSGSIQILLSDRYSNKTCGLCGNFNIFAEDDFRTQEGSLTSDPYDFANSWAMSSGEQRCKRASPPSSSCNASEEMQGLWEQCQLLKRDSVFTRCHPLVDPEPFVALCERTLCTCTQGLRCPCAALLEYARACAHQGMVLYGWTEHSECRPACPAGMEYKECVSPCTRTCQSLKINEVCQEQCVDGCSCPEGQLLDEGRCVESTECSCVHSGKRYPPGASLSRDCNTCICRNSLWICSNEECPGECIITGQSHFKSFDDRYFTFSGVCQYLLARDCQDHSFSIVIETVQCADDPDAVCTRSVTARLPSLHNSLVKLKHGGGIAIDGQDVQLPLLQGDLRIQHTVMASVRLSYGEDLQMDWDGRGRLLVKLSPVYAGRTCGLCGNFNGNKGDDFRTPAGLVEPLVEDFGNAWKLHADCADLRQQHSDPCKLNPRLAKFAEEACSLLTSPKFEACHHAVGPLPYLQNCHYDVCSCSDGRDCLCSAVANYAAACARKGVHVAWREPSFCALSCPQGQVYLQCGTPCNMTCRSLSYPDEECTELCLEGCFCPPGLYLDERGDCVPKSQCPCYYDGEIFQPEDIFSDHHTMCYCEDGFMHCSMSGAPGSLLPQHIVLSGPLGPLSHRSKRSLSCRPPMVKLVCPADNPRAEGLECAKTCQNYDLECMSMGCVSGCLCPPGMVRHENRCVALERCPCFHQGKEYAPGETVKINCNTCVCRDRKWNCTDHVCDATCSTIGVAHYLTFDGLKYMFPGECQYVLVQDYCGSNPGTFRILVGNEGCGYPSVKCKKRVTILVEGGEIELFDGEVNVKRPMKDETHFEVVESGRYIILLLGKALSVVWDHHLTISVVLKETYQEQVCGLCGNFDGVQNNDFTGSNLQVEEDPVDFGNSWKVSPQCADTRKVPLDSSPATCHNNIMKQSMVDSSCRILTSDLFQDCNKLVDPEPFLDVCIYDTCSCESIGDCACFCDTIAAYAHVCAQHGKVVTWRTATLCPQNCEERNIRENGYECEWRYNSCAPACPITCQHPEPLACPVQCVEGCHAHCPPGKILDELLQTCVDPGDCPVCEVSGRRLAPGKKVTLNPGDPEHCQICHCDGVNLTCEACREPEGLEVPPTEGPVSPTTPYVEDTPEPPLHDFFCSKLLDLVFLLDGSSKLSAAEFEVLKVFVVDMMERLHISQKRIRVALVEYHEGSHAYIQLRDRKRPSEMRRLASQVKYAGSAVASTSEVLKYTLFQIFGKIDRPEASRIALLLTASQEPQKLGRNLVRYVQGLKKKKVIVVPVGIGPHANLKQIRLIEKQAPENKAFVLSSVDELEQQRDEIINYLCDLAPEAPAPTQPPPMAQVTVGPEHLAVSTLGPKRNSMVLDVVFVLEGSDQIGEANFNRSKEFLEAVIRRMDVGQESIHVSVLQYSYTVTVETTFRETQSKQDVLQRVREIRYQGGNSTNTGLALQYVSEHTFSASLGDREQAPNLVYMVTANPASDVIKRMPGDIQVVPIGVGPHANVPELERIGWPNEPILIQDFEMLPREAPDLVLQRCCSGEGLQIPTLSPAPDCSQPLDVILLLDGSSGFPASYFDEMKSFAKAFISKANIGPQLTHVSVLQYGSITTVDVPWNVAQEKTQLLGLVDQMQQEGGPSQIGDALGFAVRYITSEGHGARPGTSKAVVILVMGASTDSVTAAAEAARSNRVTVFPIGIGDRYDPAQLKILAGPGASSNVVKLQHIEDLPTIVTLGSSFLHKLCSGYIGVCMDEDGNEKRPGDVWTLPDQCHTVTCLADGQTLLNSHRVNCERGPKPSCPNSQSPVRVEETCGCRWTCPCVCMGSSTRHIVTFDGQNFKLTGSCSYVLFQNKEQDLELILHNGACSPGARQACMKSIEVKHNGLSVELHSDMEVGVNGILVSVPYMGGDMEVNIYGAIMYEIRFNHLGHIFTFTPQNNEFQLQLSPKTFASKMYGLCGICDENGANDFMLRDGTVTTDWKRLVQDWTVQQPGKTCQPVPEEECPISSTSHCQVLLSALFAECHKVFAPATFYAMCQQDSCHLEQVCEAIASYAHLCRTNGVCVDWRTTDFCAMSCPPSLVYNHCEHGCPRHCEGNSSSCGNHPSEGCFCPSHQVMLEGNCVPEEACTQCVGEDGVRHQFLETWVPDHQPCQICTCLSGRKVNCTSHPCPTARVPTCGPCEVARLHQNADQCCPEYECVCDLVSCDLPPVPHCEGGLQPTLTNPGECRPNFTCACRKEECRRESPPSCPPHRTPTLRKTQCCDEYECACNCVNSTVTCPLGYLSSAITNDCGCTTITCLPDKVCVHRGTVYPIGQLWEEGCDICTCTDMEDAVMGLRVAQCSQKSCEESCQLGFTYVLHEGECCGRCLPSACEVVIGSPRGDSQSYWKDVGSHWASPENPCLINECVRVKEEVFVQQRNVSCPQLDVPTCPVGFQLSCASSECCPTCHCEPVQACMLNGTIIGPGKSMMIDVCTTCHCTAQVGIISGFKLECSKTTCTACPEGYKEENIPGECCWRCLPVACTIQLRGGQIMTLQRDEMFQDGCDSHFCKVNERGEYIWEKRVTGCPPFDEHKCLAQGGKIMKIPGTCCDTCEEPDCKDIIARLQYVKVGSCKSEEEVDIHYCQGKCASKALYSIETEDVQDQCSCCSPTRTEPMQVPLRCTNGSIVYHEVLNAMQCRCSPRKCSK

SEQ ID NO: 111 - protein, 2813 aa, Callithrix jacchus
MIPARFARVLLALALTLPGILCAEGTRGRSSMARCSLFGSDVINTFDGSMYSFAGYCSYLLAGDCQKHSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNLNIFAEDDFMTQEGTLTSDPYDFANSWALSSGEQWCERASPPSGSCNISSGEMQKGLWEQCQLLKSTSVFARCHPLVDPEPFVALCEKTLCECTEGLECVCPTFLEYARTCAQEGMVLYGWTNHGACSPVCPAGMEYKQCVPPCTRTCQSLHINEVCQQQCVDGCSCPEGQLLDEGLCVESTECPCMHSGKRYPPGTNLSQDCNTCICRNSQWVCSNEDCPGECLVTGQSHFKSFDNKYFTFSGICQYLLARDCQDHSFSIVIETVQCADDPDAVCTRSVTIRLPGLHNSLVKLKHGGGVAMDGQDVQLPLLKGDLRIQHTVTTSVHVNYGEDLQMDWDGRGRLLVKLSPVYSGKTCGLCGNYNGNQGDDFLTPSGLAEPRVEDFGNAWKLHGDCQDLQKQHSDPCALNPRMTRFAAEACAVLTSPTFEACHRAVSPLPYLRNCRYDVCSCSDGRECLCGALASYAAACAGRGVRIAWREPGRCELNCPKGQVYLQCGTPCNLTCRSLSYPDEECSEDCLEGCFCPPGLYMDEMGDCVPKAQCPCYYDGEIFQPEDIFSDHHTVCYCEGGFMHCTMSEVPRSLLPDAVLSSPLSHRSKRSLSCRPPMVKLVCPADNPRAEGLECAKTCQNYDLECMSTGCVSGCLCPPGMVRHENRCVALERCPCFHQGQEYAPGETVKIDCNTCVCRDRKWNCTDHMCDATCSTIGMAHYLTFDGLKYMFPGECQYVLVQDYCDSNPGTFRILVGNEGCSYPSVKCKKRVTILVEGGEIELFDGEVNVQRPMKDETHFEVVESGRYIILLLGKALSVVWDRHLSISVVLKQTYQEQVCGLCGNFDGIQNNDLTSSNLQVEEDAVNFGNSWKVSSQCADTRRVPLDSSPATCRNNIMKQTMVDSSCRILTSDVFQDCNKLVDPEPYLDACIYDTCSCESIGDCTCFCDTVAAYAHMCAQHGKVVTWRTTTLCPQSCEERNLRESGYECEWRYNSCAPACRITCQHPEPLACPVQCVEGCHAHCPPGKILDELLQTCVNPEDCPVCEVAGRRLASGKKVTLNPSDPEHCQICHCDGVNLTCEACQEPEGLVMPPTDAPVSPTTPYVEDVSEAPLHDFYCSKLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIILLLMASQEPQRMSRNFVRYVQGLKKKKVIVIPVGIGPHANLKQIRLIEKQAPENKAFVLSGVDELEQQRDEIVSYLCDLAPEAPPPTMPPHMAQVTVGPGLLGVSPLGPKRKSMVLDVAFVLEGSDKIGEADFNRTKEFMAEVIQRMDVGQDGIHVTVLQYSYMVTVEYPFSEAQTKGDILQRVRDIRYQGGNRTNTGLALQHLSEHSFLVSQGDREQAPNLVYMVTGNPASDEIKRLPGDIQVVPIGVGPHANVQELETIGWPNAPILIQDFETLPREAPDLVLQRCCSGEGLQMPKLAPDPDCSQPLDVVLLLDGSSSSPASYFDEMKSFAKAFISKAKLGPHLTQVSVLQYGSITTIDVPWNAAMEKAHLLSLVDVMQREGGPSQIGNALDFAVRYLTSEVHGARPGASKAVVILVTDVSVDSVGAAADAARANRVTVFPIGIGDRYDAAQLRTLAGPAADSNVVSLQRIEDLPTMVTLGNSFLHKLCSGFVRICMDEDGNEKRPGDVWTLPDQCHTVTCQPDGQTLLKSHRVNCDRGPRPSCPNSQSPLKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVAGNVEVSIYGAIMHEVRFNHLGHIFTFTPQNNEFQLQLSPKTFASKTYGLCGICDENGANDFMLRDGTVTTDWKTLVQEWTVQQSGQTCQPILEEQCLVSDSSQCQVLLSTLFAECHKVLAPATFYAICQQDSCHREQVCEVISSYAHLCRSSGVCVDWRTPDFCAMSCPSSLVYNHCERGCPRHCDGNVSSCGDHPSEGCFCPPNQVMLEGSCVPKEACTQCIGEDGVRHQFLEAWVPDHQPCQICTCLSGRKVNCTTQPCPTAKAPTCGLCEVAHLRQNADQCCPEYECVCDPVSCDLPAVPHCEDGLQPMLTNPGECRPNFTCACRKEECERVSPPSCPPHRFLTLRKTQCCDEYECACNCVNSTVSCPLGYLASTATNDCGCTTTTCLPDKVCVHRGTIYPVGQFWEEGCDVCTCTDMEDAVMGLRVAQCSQKPCEDSCRSGFTYVLHEGECCGRCLPSACEVVTGSRRGDSQSSWKSVGSRWASLENPCLINECVRVKEEVFVQQRNVSCPQLEVPFCPPGFQLSCKTSECCPRCRCEPMEACMLNGTIIGPGKSVMVDVCTACHCIVEAGAASGFQLECRKTTCKPCPLGYKEENNPGECCGRCLPTACTIRLRGGQIMTLKRDEMLQDGCDSHSCKVNEIGEYIWEKRVASCPPFDEHECLAEGGKIMKTPGTCCNRCEVPECKDITARLQYVKVGSCKSEVEVDIHYCQGKCASKAIYSIDIEDVQDQCSCCSPTWTEPMRVPLHCTNGSVVYHEILNAMQCKCSPRKCSK

SEQ ID NO: 112 - protein, 2813 aa, Callithrix jacchus
MIPARFARVLLALALTLPGILCAEGTRGRSSMARCSLFGSDVINTFDGSMYSFAGYCSYLLAGDCQKHSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNLNIFAEDDFMTQEGTLTSDPYDFANSWALSSGEQWCERASPPSGSCNISSGEMQKGLWEQCQLLKSTSVFARCHPLVDPEPFVALCEKTLCECTEGLECVCPTFLEYARTCAQEGMVLYGWTNHGACSPVCPAGMEYKQCVPPCTRTCQSLHINEVCQQQCVDGCSCPEGQLLDEGLCVESTECPCMHSGKRYPPGTNLSQDCNTCICRNSQWVCSNEDCPGECLVTGQSHFKSFDNKYFTFSGICQYLLARDCQDHSFSIVIETVQCADDPDAVCTRSVTIRLPGLHNSLVKLKHGGGVAMDGQDVQLPLLKGDLRIQHTVTTSVHVSYGEDLQMDWDGRGRLLVKLSPVYSGKTCGLCGNYNGNQGDDFLTPSGLAEPRVEDFGNAWKLHGDCQDLQKQHSDPCALNPRMTRFAAEACAVLTSPTFEACHRAVSPLPYLRNCRYDVCSCSDGRECLCGALASYAAACAGRGVRIAWREPGRCKLNCPKGQVYLQCGTPCNLTCRSLSYPDEECSEDCLEGCFCPPGLYMDEMGDCVPKAQCPCYYDGEIFQPEDIFSDHHTVCYCEGGFMHCTMSEVPGSLLPDAVLSSPLSHRSKRSLSCRPPMVKLVCPADNPRAEGLECAKTCQNYDLECMSTGCVSGCLCPPGMVRHENRCVALERCPCFHQGQEYAPGETVKIDCNTCVCRDRKWNCTDHMCDATCSTIGMAHYLTFDGLKYMFPGECQYVLVQDYCDSNPGTFRILVGNEGCSYPSVKCKKRVTILVEGGEIELFDGEVNVQRPMKDETHFEVVESGRYIILLLGKALSVVWDRHLSISVVLKQTYQEQVCGLCGNFDGIQNNDLTSSNLQVEEDAVNFGNSWKVSSQCADTRRVPLDSSPATCRNNIMKQTMVDSSCRILTSDVFQDCNKLVDPEPYLDACIYDTCSCESIGDCTCFCDTVAAYAHMCAQHGKVVTWRTTTLCPQSCEERNLRESGYECEWRYNSCAPACRITCQHPEPLACPVQCVEGCHAHCPPGKILDELLQTCVNPEDCPVCEVAGRRLASGKKVTLNPSDPEHCQICHCDGVNLTCEACQEPEGLVMPPTDAPVSPTTPYVEDVSEAPLHDFYCSKLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIILLLMASQEPQRMSRNFVRYVQGLKKKKVIVIPVGIGPHANLKQIRLIEKQAPENKAFVLSGVDELEQQRDEIVSYLCDLAPEAPPPTMPPHMAQVTVGPGLLGVSPLGPKRKSMVLDVAFVLEGSDKIGEADFNRTKEFMAEVIQRMDVGQDGIHVTVLQYSYMVTVEYPFSEAQTKGDILQRVRDIRYQGGNRTNTGLALQHLSEHSFLVSQGDREQAPNLVYMVTGNPASDEIKRLPGDIQVVPIGVGPHANVQELETIGWPNAPILIQDFETLPREAPDLVLQRCCSGEGLQMPKLAPDPDCSQPLDVVLLLDGSSSSPASYFDEMKSFAKAFISKAKLGPHLTQVSVLQYGSITTIDVPWNAAMEKAHLLSLVDVMQREGGPSQIGNALDFAVRYLTSEVHGARPGASKAVVILVTDVSVDSVGAAADAARANRVTVFPIGIGDRYDAAQLRTLAGPAADSNVVSLQRIEDLPTMVTLGNSFLHKLCSGFVRICMDEDGNEKRPGDVWTLPDQCHTVTCQPDGQTLLKSHRVNCDRGPRPSCPNSQSPLKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVAGNVEVSIYGAIMHEVRFNHLGHIFTFTPQNNEFQLQLSPKTFASKTYGLCGICDENGANDFMLRDGTVTTDWKTLVQEWTVQQSGQTCQPILEEQCLVSDSSQCQVLLSTLFAECHKVLAPATFYAICQQDSCHREQVCEVISSYAHLCRSSGVCVDWRTPDFCAMSCPSSLVYNHCERGCPRHCDGNVSSCGDHPSEGCFCPPNQVMLEGSCVPKEACTQCIGEDGVRHQFLEAWVPDHQPCQICTCLSGRKVNCTTQPCPTAKAPTCGLCEVAHLRQNADQCCPEYECVCDPVSCDLPAVPHCEDGLQPMLTNPGECRPNFTCACRKEECERVSPPSCPPHRFLTLRKTQCCDEYECACNCVNSTVSCPLGYLASTATNDCGCTTTTCLPDKVCVHRGTIYPVGQFWEEGCDVCTCTDMEDAVMGLRVAQCSQKPCEDSCRSGFTYVLHEGECCGRCLPSACEVVTGSRRGDSQSSWKSVGSRWASLENPCLINECVRVKEEVFVQQRNVSCPQLEVPFCPPGFQLSCKTSECCPRCRCEPMEACMLNGTIIGPGKSVMVDVCTACHCIVEAGAASGFQLECRKTTCKPCPLGYKEENNPGECCGRCLPTACTIRLRGGQIMTLKRDEMLQDGCDSHSCKVNEIGEYIWEKRVASCPPFDEHECLAEGGKIMKTPGTCCNRCEVPECKDITARLQYVKVGSCKSEVEVDIHYCQGKCASKAIYSIDIEDVQDQCSCCSPTWTEPMRVPLHCTNGSVVYHEILNAMQCKCSPRKCSK

SEQ ID NO: 113 - protein, 2813 aa, Homo sapiens
MIPARFAGVLLALALILPGTLCAEGTRGRSSTARCSLFGSDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPALLEYARTCAQEGMVLYGWTDHSACSPVCPAGMEYRQCVSPCARTCQSLHINEMCQERCVDGCSCPEGQLLDEGLCVESTECPCVHSGKRYPPGTSLSRDCNTCICRNSQWICSNEECPGECLVTGQSHFKSFDNRYFTFSGICQYLLARDCQDHSFSIVIETVQCADDRDAVCTRSVTVRLPGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECTKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPEDCPVCEVAGRRFASGKKVTLNPSDPEHCQICHCDVVNLTCEACQEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRITLLLMASQEPQRMSRNFVRYVQGLKKKKVIVIPVGIGPHANLKQIRLIEKQAPENKAFVLSSVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPAPDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPDSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLSCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 114 - protein, 2816 aa, Mus musculus
MGKMNPFRYEICLLVLALTWPGTLCTEKPRDRPSTARCSLFGDDFINTFDETMYSFAGGCSYLLAGDCQKRSFSILGNFQDGKRMSLSVYLGEFFDIHLFANGTVTQGDQSISMPYASQGLYLEREAGYYKLSSETFGFAARIDGNGNFQVLMSDRHFNKTCGLCGDFNIFAEDDFRTQEGTLTSDPYDFANSWALSSEEQRCKRASPPSRNCESSSGDMHQAMWEQCQLLKTASVFARCHPLVDPESFVALCEKILCTCATGPECACPVLLEYARTCAQEGMVLYGWTDHSACRPACPAGMEYKECVSPCPRTCQSLSINEVCQQQCVDGCSCPEGELLDEDRCVQSSDCPCVHAGKRYPPGTSLSQDCNTCICRNSLWICSNEECPGECLVTGQSHFKSFDNRYFTFSGICQYLLARDCEDHTFSIVIETMQCADDPDAVCTRSVSVRLSALHNSLVKLKHGGAVGIDGQDVQLPFLQGDLRIQHTVMASVRLSYAEDLQMDWDGRGRLLVKLSPVYSGKTCGLCGNYNGNKGDDFLTPAGLVEPLVVDFGNAWKLQGDCSDLRRQHSDPCSLNPRLTRFAEEACALLTSSKFEACHHAVSPLPYLQNCRYDVCSCSDSRDCLCNAVANYAAECARKGVHIGWREPGFCALGCPQGQVYLQCGNSCNLTCRSLSLPDEECSEVCLEGCYCPPGLYQDERGDCVPKAQCPCYYDGELFQPADIFSDHHTMCYCEDGFMHCTTSGTLGSLLPDTVLSSPLSHRSKRSLSCRPPMVKLVCPADNPRAQGLECAKTCQNYDLECMSLGCVSGCLCPPGMVRHENKCVALERCPCFHQGAEYAPGDTVKIGCNTCVCRERKWNCTNHVCDATCSAIGMAHYLTFDGLKYLFPGECQYVLVQDYCGSNPGTFQILVGNEGCSYPSVKCRKRVTILVDGGELELFDGEVNVKRPLRDESHFEVVESGRYVILLLGQALSVVWDHHLSISVVLKHTYQEQVCGLCGNFDGIQNNDFTTSSLQVEEDPVNFGNSWKVSSQCADTRKLSLDVSPATCHNNIMKQTMVDSACRILTSDVFQGCNRLVDPEPYLDICIYDTCSCESIGDCACFCDTIAAYAHVCAQHGQVVAWRTPTLCPQSCEEKNVRENGYECEWRYNSCAPACPVTCQHPEPLACPVQCVEGCHAHCPPGRILDELLQTCVDPQDCPVCEVAGRRLAPGKKITLSPDDPAHCQNCHCDGVNLTCEACQEPGGLVAPPTDAPVSSTTPYVEDTPEPPLHNFYCSKLLDLVFLLDGSSMLSEAEFEVLKAFVVGMMERLHISQKRIRVAVVEYHDGSRAYLELKARKRPSELRRITSQIKYTGSQVASTSEVLKYTLFQIFGKIDRPEASHITLLLTASQEPPRMARNLVRYVQGLKKKKVIVIPVGIGPHASLKQIRLIEKQAPENKAFLLSGVDELEQRRDEIVSYLCDLAPEAPAPTQPPQVAHVTVSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPTLPPLPDCSQPLDVVLLLDGSSSLPESSFDKMKSFAKAFISKANIGPHLTQVSVIQYGSINTIDVPWNVVQEKAHLQSLVDLMQQEGGPSQIGDALAFAVRYVTSQIHGARPGASKAVVIIIMDTSLDPVDTAADAARSNRVAVFPVGVGDRYDEAQLRILAGPGASSNVVKLQQVEDLSTMATLGNSFFHKLCSGFSGVCVDEDGNEKRPGDVWTLPDQCHTVTCLANGQTLLQSHRVNCDHGPRPSCANSQSPVRVEETCGCRWTCPCVCTGSSTRHIVTFDGQNFKLTGSCSYVIFQNKEQDLEVLLHNGACSPGAKQACMKSIEIKHAGVSAELHSNMEMAVDGRLVLAPYVGENMEVSIYGAIMYEVRFTHLGHILTYTPQNNEFQLQLSPKTFASKMHGLCGICDENGANDFTLRDGTVTTDWKRLVQEWTVQQPGYTCQAVPEEQCPVSDSSHCQVLLSASFAECHKVIAPATFHTICQQDSCHQERVCEVIASYAHLCRTSGVCVDWRTTDFCAMSCPPSLVYNHCERGCPRHCDGNTSFCGDHPSEGCFCPQHQVFLEGSCVPEEACTQCVGEDGVRHQFLETWVPDHQPCQICMCLSGRKINCTAQPCPTARAPTCGPCEVARLKQSTNLCCPEYECVCDLFNCNLPPVPPCEGGLQPTLTNPGECRPTFTCACRKEECKRVSPPSCPPHRTPTLRKTQCCDEYECACSCVNSTLSCPLGYLASATTNDCGCTTTTCLPDKVCVHRGTVYPVGQFWEEGCDTCTCTDMEDTVVGLRVVQCSQRPCEDSCQPGFSYVLHEGECCGRCLPSACKVVAGSLRGDSHSSWKSVGSRWAVPENPCLVNECVRVEDAVFVQQRNISCPQLAVPTCPTGFQLNCETSECCPSCHCEPVEACLLNGTIIGPGKSVMVDLCTTCRCIVQTDAISRFKLECRKTTCEACPMGYREEKSQGECCGRCLPTACTIQLRGGRIMTLKQDETFQDGCDSHLCRVNERGEYIWEKRVTGCPPFDEHKCLAEGGKIVKIPGTCCDTCEEPDCKDITAKVQYIKVGDCKSQEEVDIHYCQGKCASKAVYSIDIEDVQEQCSCCLPSRTEPMRVPLHCTNGSVVYHEVINAMQCRCSPRNCSK

SEQ ID NO: 115 - protein, 2813 aa, Callithrix jacchus
MIPARFARVLLALALTLPGILCAEGTRGRSSMARCSLFGSDVINTFDGSMYSFAGYCSYLLAGDCQKHSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNLNIFAEDDFMTQEGTLTSDPYDFANSWALSSGEQWCERASPPSGSCNISSGEMQKGLWEQCQLLKSTSVFARCHPLVDPEPFVALCEKTLCECTEGLECVCPTFLEYARTCAQEGMVLYGWTNHGACSPVCPAGMEYKQCVPPCTRTCQSLHINEVCQQQCVDGCSCPEGQLLDEGLCVESTECPCMHSGKRYPPGTNLSQDCNTCICRNSQWVCSNEDCPGECLVTGQSHFKSFDNKYFTFSGICQYLLARDCQDHSFSIVIETVQCADDPDAVCTRSVTIRLPGLHNSLVKLKHGGGVAMDGQDVQLPLLKGDLRIQHTVTTSVHVNYGEDLQMDWDGRGRLLVKLSPVYSGKTCGLCGNYNGNQGDDFLTPSGLAEPRVEDFGNAWKLHGDCQDLQKQHSDPCALNPRMTRFAEEACAVLTSPTFEACHRAVSPLPYLRNCRYDVCSCSDGRECLCGALASYAAACAGRGVRIAWREPGRCELNCPKGQVYLQCGTPCNLTCRSLSYPDEECSEDCLEGCFCPPGLYMDEMGNCVPKAQCPCYYDGEIFQPEDIFSDHHTVCYCEGGFMHCTMSEVPGSLLPDAVLSSPLSHRSKRSLSCRPPMVKLVCPADNPRAEGLECAKTCQNYDLECMSMGCVSGCLCPPGMVRHENRCVALERCPCFHQGQEYAPGETVKIDCNTCVCRDRKWNCTDHMCDATCSTIGMAHYLTFDGLKYMFPGECQYVLVQDYCDSNPGTFRILVGNEGCSYPSVKCKKRVTILVEGGEIELFDGEVNVQRPMKDETHFEVVESGRYIILLLGKALSVVWDRHLSISVVLKQTYQEQVCGLCGNFDGIQNNDLTSSNLQVEEDAVNFGNSWKVSSQCADTRRVPLDSSPATCRNNIMKQTMVDSSCRILTSDVFQDCNKLVDPEPYLDACIYDTCSCESIGDCTCFCDTVAAYAHMCAQHGKVVTWRTTTLCPQSCEERNLRESGYECEWRYNSCAPACRITCQHPEPLACPVQCVEGCHAHCPPGKILDELLQTCVNPEDCPVCEVAGRRLASGKKVTLNPSDPEHCQICHCDGVNLTCEACQEPEGLVMPPTDAPVSPTTPYVEDVSEAPLHDFYCSKLLDLVFLLDGSSRLSEAEFEVLKAFVVDMMERLRISQKWVRVAVVEYHDGSHAYIGLKDRKRPSELRRIASQVKYAGSQVASTSEVLKYTLFQVFGKIDRPEASRIILLLMASQEPQRMSRNFVRYVQGLKKKKVIVIPVGIGPHANLKQIRLIEKQAPENKAFVLSGVDELEQQRDEIVSYLCDLAPEAPPPTMPPHMAQVTVGPGLLGVSPLGPKRKSMVLDVAFVLEGSDKIGEADFNRTKEFMAEVIQRMDVGQDGIHVTVLQYSYMVTVEYPFSEAQTKGDILQRVRDIRYQGGNRTNTGLALQHLSEHSFLVSQGDREQAPNLVYMVTGNPASDEIKRLPGDIQVVPIGVGPHANVQELETIGWPNAPILIQDFETLPREAPDLVLQRCCSGEGLQMPKLAPDPDCSQPLDVVLLLDGSSSSPASYFDEMKSFAKAFISKAKLGPHLTQVSVLQYGSITTIDVPWNAAMEKAHLLSLVDVMQREGGPSQIGNALDFAVRYLTSEVHGARPGASKAVVILVTDVSVDSVGAAADAARANRVTVFPIGIGDRYDAAQLRTLAGPAADSNVVSLQRIEDLPTMVTLGNSFLHKLCSGFVRICMDEDGNEKRPGDVWTLPDQCHTVTCQPDGQTLLKSHRVNCDRGPRPSCPNSQSPLKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVAGNVEVSIYGAIMHEVRFNHLGHIFTFTPQNNEFQLQLSPKTFASKTYGLCGICDENGANDFMLRDGTVTTDWKTLVQEWTVQQSGQTCQPILEEQCLVSDSSQCQVLLSTLFAECHKVLAPATFYAICQQDSCHREQVCEVISSYAHLCRSSGVCVDWRTPDFCAMSCPSSLVYNHCERGCPRHCDGNVSSCGDHPSEGCFCPPNQVMLEGSCVPKEACTQCIGEDGVRHQFLKAWVPDHQPCQICTCLSGRKVNCTTQPCPTAKAPTCGLCEVAHLRQNADQCCPEYECVCDPVSCDLPAVPHCEDGLQPMLTNPGECRPNFTCACRKEECERVSPPSCPPHRFLTLRKTQCCDEYECACNCVNSTVSCPLGYLASTATNDCGCTTTTCLPDKVCVHRGTIYPVGQFWEEGCDVCTCTDMEDAVMGLRVAQCSQKPCEDSCRSGFTYVLHEGECCGRCLPSACEVVTGSRRGDSQSSWKSVGSRWASLENPCLINECVRVKEEVFVQQRNVSCPQLEVPFCPPGFQLSCKTSECCPRCRCEPMEACMLNGTIIGPGKSVMVDVCTACHCIVEAGAASGFQLECRKTTCKPCPLGYKEENNPGECCGRCLPTACTIRLRGGQIMTLKRDEMLQDGCDSHSCKVNEIGEYIWEKRVASCPPFDEHECLAEGGKIMKTPGTCCNRCEVPECKDITARLQYVKVGSCKSEVEVDIHYCQGKCASKAIYSIDIEDVQDQCSCCSPTRTEPMRVPLHCTNGSVVYHEILNAMQCKCSPRKCSK

SEQ ID NO: 116 - protein, 2813 aa, Pan paniscus
MIPARFAGVLLALALILPGTLCAEGTRGRSSMARCSLFGNDFVNTFDGSMYSFAGYCSYLLAGGCQKRSFSIIGDFQNGKRVSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSSSCNISSGEMQKGLWEQCQLLKSTSVFARCHPLVDPEPFVALCEKTLCECAGGLECACPAFLEYARTCAQEGMVLYGWTDHSACSPVCPDGMEYKQCVSPCTRTCQSLHINEMCQERCVDGCSCPEGQLLDEGLCVESTECPCVHSGKRYPPGASLSRDCNTCICRNSQWICSNEECPGECLVTGQSHFKSFDNRYFTFSGICQYLLARDCQDHSFSIVIETVQCADDRDAVCTRSVTVRLRGLHNSLVKLKHGAGVAMDGQDVQLPLLKGDLRIQHTVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVSVAWREPGRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNLRAEGLECAKTCQNYDLECMSMGCVSGCLCPPGMVRHENRCVALERCPCFHQGKEYAPGETVKIGCNTCVCRDRKWNCTDHVCDATCSTIGMAHYLTFDGLKYLFPGECQYVLVQDYCGSNPGTFRILVGNKGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACQVTCQHPEPLACPVQCVEGCHAHCPPGKILDELLQTCVDPKDCPVCEVAGRRFASGKKVTLNPSDPEHCQICHCDGVNLTCEACQEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFSKIDRPEASRIALLLMASQEPQRMSRNFVRYVQGLKKKKVIVIPVGIGPHANLKQIRLIEKQAPENKAFVLSGVDELEQQRDEIVSYLCDLAPEAPPPTLPPHVAQVTVGLGLLGLSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPASDCSQPLDVILLLDGSSSFPASYFDEMKSFAKAFISKANIGPRLTQVSVLQYGSITTIDVPWNVVPEKAHLLSLVDVMQREGGPSQIGDALGFAVRYLTSEMHGARPGASKAVVILVTDVSVDSVGAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGAIMHEVRFNHLGHIFTFTPQNNEFQLQLSPKTFASKTYGLCGICDENRANDFMLRDGTVTTDWKTLVQEWTVQRPGQTCQPILEEQCLVPNSSHCQVLLLPLFAECHKVLAPATFYAICQQDSCHQEQVCEVIASYAHLCRTNGVCVDWRTPDFCAMSCPPSLVYNHCEHGCPRHCDGNVSSCGDHPSEGCFCPPDKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCERGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDVVMGLRVAQCSQKPCEDSCRSGFTYVLHEGECCGRCLPSACEVVTGSPRGDSQSSWKSVGSQWASPENPCLINECVRVKEEVFIQQRNVSCPQLEVPVCPSGFQLNCKTSACCPSCRCERMEACMLNGTVIGPGKTVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVALHCTNGSVVYHEVLNAMECKCSPRKCSK

SEQ ID NO: 117 - protein, 2813 aa, Saimiri boliviensis boliviensis
MIPARFARVLLAVALTLPGIVCAEGTRDRSSMARCSLFGSDFINTFDGSMYSFAGYCSYLLAGDCQKRSFSIIGDFQNGKRVSLSVYLGEFFDIRLFVNGTVTQGDQRVSMPYASKGLYLETEAGYYKLSGEAYGFVARIDGSGNFQVLLSDRYFNQTCGLCGNFNIFAEDDFMTQEGTLTSDPYDFANSWALSSGEQWCERASPPSGSCNISSGEMQKGLWEQCQLLKSTSVFARCHPLVDPEPFVALCEKTLCACTEGLECVCPAFLEYARTCAQEGMVLYGWTNHGTCSPVCPAGMEYKQCVSPCTRTCRSLRINEVCQERCVDGCSCPEGQLLDEGVCVESTECPCVHSGKRYPPGTSLSRDCNTCICRNSQWICSNEECPGECLVTGQSHFKSFDNKYFTFSGICQYLLARDCQDHSFSIVIETVQCADDPDAVCTRFVTVRLPGLHNSLVKLKHGGGVAMDGQDVQLPLLKGDLRIQHTVTTSVHISYGEYLQMDWDGRGRLLVKLAPVYSGKTCGLCGNYNGNQGDDFLTPSGLAEPRVEDFGNAWKLQGDCQDLQKQHSDPCALNPRMTRFSEEACAVLTSPTFEACHRAVSPRPYLRNCRYDVCSCSDGRQCLCGALASYAAACAGRGVRIAWRGPGRCELNCPKGQVFLQCGTPCNLTCRSLSYPDEECSEDCLEGCFCPPGLYMDERGDCVPKAQCPCYYDGEIFQPEDIFSDHHTMCYCEDGYMHCSMSEVPGSLLPDAVLSSPLSHRSKRSLSCRPPMVKLVCPADNPRAEGLECAKTCQNYDLECMSTGCVSGCLCPPGMVRHENRCVALERCPCFHQGKEYAPGETVKIDCNTCVCRDRKWNCTGHVCDATCSTIGMAHYLTFDGLEYMFPGECQYVLVQDYCGSNPGTFRILVGNEGCSHPSVKCKKRVTILVEGGEIELFDGEVNVKRPMKDETHFEVVESGRYIILLLGKALSVVWDHHLSISVVLKQTYQEQVCGLCGNFDGIQNNDLTSSNLQVEEDSVDFGNSWKVSSQCADTRKVPLDSSPATCRNNIMKQTMVDSSCRILTSDIFQDCNKLVDPEPYLDACIYDTCSCESTGDCTCFCDTIAAYAHMCAQHGKVVTWRTTTLCPQSCEERNLRESGYECEWRYNSCAPACRVTCQHPEPLACPVQCVEGCHAHCPPGKILDELLQTCINPEDCPVCEVAGRRLASGKKVTLNPGDPEHCQICHCDGVNLTCEACQEPRGLVMPPTDAPVSPTTAYVEDVSEAPLHDFYCSKLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIILLLMASQEPQRMSRNFARYVQGLKKKKVIVIPVGIGPHANLKQIRLIEKQAPENKAFVLSGVDELEQQRDEIVSYLCDLAPEAPPPTIPHNMAQVTMGPGLLEVSPLGHKRKSMILDVAFVLEGSDRIGEADFNRTKEFMEEVIQRMDVGQDGIHVTVLQYSYMVTVEYPFSEAQSKGDILQRVREIRYQGGNRTNTGLALQHLSEHSFLVSQGDREQAPNLVYMVTGNPASDEIKRLPGDIQVVPIGVGPHANVQELERIGWPNAPILIQDFETLPREAPDLVLQRCCSGEGLQIPTLAPASDCSQPLDVVLLLDGSSGSPASYFDEMKSFAKAFISKAKLGPHLTRVSVLQYGSITTIDVPWNVATEKAHLLSLVDVMQREGGPSQIGNGLDFAVRYLTSEVHGARPGASKAVVILVTDVSVDSVGAAADAARANRVTVFPIGIGDRYDAAQLRILAGPAADSNVVSLQRIEDLPTMVTLGNSFLHKLCSGFVRICMDEDGNEKRPGDVWTLPDQCHTVTCQLDGQTLLKSHRVNCDRGPRPSCPNSQSPVKVEETCGCRWTCPCVCTGSSTRHIVTFDGQNFKLTGSCSYVLFQNKEQDVEVILHNGACSPGARQGCMKSIEVKHSALSVELHSDMEVAVNGRLVSVPYVGGNMEVSIYGAIMHEVRFNHLGHIFTFTPQNNEFQLQLSPKTFASKTYGLCGICDENGANDFMLRDGTVTTDWKTLVQEWTVQQSGQTCQPILEEQCPVSDSSQCQVLLSALFAECHKVLAPATFYAICQQDSCHQEQVCEVIASYAHLCRTSGVCVDWRTPDFCAMSCPSSLVYNHCEHGCPRHCDGNVSSCGDHPSEGCFCPPNQVMLEGSCVPKEACTQCIGEDGVRHQFLEAWVPDHQPCQICTCLSGRKINCTTQPCPTAKAPTCGLCEVARLRQNADQCCPEFECVCDPVSCDLPAVPHCEGGLQPILTNPGECRPKFTCACRKEECEKASPPSCPPHRFLTLRKTQCCDEYECACNCVNSTVSCPLGYLASTATNDCGCSTTTCLPDKVCVHRGTIYPVGQFWEEGCDVCTCTDMEDAVMGLRVAQCSQKPCEDSCRSGFTYVLHEGECCGRCLPSACEVVTGSRRGDSQSSWKSVGSRWASLENPCLINECVRVKEEVFVQQRNVSCPQLEVPFCPPGFQLSCKTSKCCPRCGCEPVEACMLNGTIIGPGKSVMVDVCTACHCIVEAGAASGFQLECRKTTCKPCPLGYKEENNPGECCGRCLPTACTIQLRGGQIMMLKRDETLQDGCDSHSCKVNEVGEYIWEKRVASCPPFDEHECLADGGKIMKTPGTCCDRCEVPECKDITARLQYVKVGSCKSEVQVDIHYCQGKCASKAMYSIDIEDVQDQCSCCSPTRTEPMRVPLRCTNGSVVYHEVLNAMQCKCSPRKCSK

SEQ ID NO: 118 - protein, 2813 aa, Microtus ochrogaster
MNSARFEIWMLALVLTWPGTVYTEKTQDRPSMARCSLFGDDFINTFDETMYSFAGGCSYLLAGDCHKRSFSILGNFQDGKRVSLSVYLGEFFDIHLFANGTVMQGDRSISMPYASEGLYLETEAGYYKLSSEAYGFVARIDGDGNFQVLMSDRHFNKTCGLCGDFNIFAEDDFRMQEGALTSDPYDFANSWALSSGEQRCKRASPPSSHCNSSSGDMQKAMWEQCQLLKTASVFARCHPLVDPEPFVALCEKTLCTCTHGPECACPALLEYARTCAQEGMVLYGWTDHSACHPACPAGMEYKECVSPCPRTCQSLPINEVCQQHCVDGCGCPDGELLDEGLCVQSSECSCVHAGKRYPPGTSLSQDCNTCICRNSQWICSNEECPGECLVTGQSHFKSFDDRYFTFSGICQYLLARDCQDHAFSIVIETMQCADDPDAVCTRSVTVRLSALHNSLVKLKHGGGVAIDGQDVQIPLLQGDLRIQHTVMASVRLSYGEDLQMDWDGRGRLLVKLSPVYSGKTCGLCGNYNGNKGDDFLTPAGLVEPMVVDFGNSWKLQGDCPDLHRQHSDPCSLNPRLTRFAEESCMLLTSSKFEACHHAVSPLPYLQNCRYDVCSCADGRDCLCSAVANYAVACAGKGIHIGWREPDFCALSCPQGQVYLECGNSCNLTCRSLSYPDEECSDVCLEGCFCPPGLYQDERGDCVPKAQCPCYYDGELFQPADIFSDHHTMCYCEDGFMHCTTSSTPGSLLPDIVLSSPFSHRSKRSLSCRPPMVKLVCPADNPRAQGLECAKTCQNYDLECMSVGCVSGCLCPPGMVRHENKCVALERCPCFHQGQEYAPGDTVKIGCNTCVCLDRKWNCTSHVCDATCSALGMAHYITFDGLKYLFPGECQYVLAQDYCGNNPGTFRILVGNEGCSYPSVKCKKRVTVLVEGGEIELFDGEVNVKKPLKDESHFEVVESGRYIILLLSQGLSVVWDRHLSVSVVLKHTHQDQVCGLCGNFDGIQNNDFTSSSLQVEEDPVDFGNSWKVSSQCADARKLSLDVSPATCHNNIMKQTMVDSSCRILTSDIFQGCNRLVDPEPYLDVCIYDTCSCESIGDCTCFCDTIAAYAHVCAQHGQVVAWRTPALCPQTCEERNIRENGYECEWRYNSCAPACPVTCQHPEPLACPVQCVEGCHAHCPSGRILDELLQTCVDPQDCPVCEVAGRRLAPGKKITLNPDDPAHCQNCHCDGVNLTCEACREPGGLAVPPTDAPVSSTTPYVEDTPEPPLHSFYCSKLLDLVFLLDGSSRLSEAEFEVLKTFVVGMMERLHISQRRIRVAVVEYHDGSHAYIDLTARKRPSELRRIASQVKYAGSQVASTSEVLKYTMFQIFGKVDRPEASRIALLLTASQEPPRLARNLVRYVQGLKKKKVSVIPVGIGPHASLKQIRLIEKQAPENKAFLLSGVDELEQRRDEIINYLCDLAPEAQAPTQPPQVAQITTGPGILGISSPGPKRKSMVLDVVFVLEGSDEIGEANFNKSKEFLEEVIQRMDVGQQGIHISVLQYSYKVTVEYTFNEAQTKDDVLRHVREIRYHGGNRTNTAQALQYLSEHSFSPSQGDRKQAPNLVYMVTGNPASDEIKRMPGDIQVVPIGVGPHANPQELERIGWPHAPIFIRDFETLPREAPDLVLQRCCSREGLQLPTLSPTPDCSQPLDVVLLLDGSSGLPESYFDTMKSFAKAFISKANIGPHLTQVSVMQYGSINTIDIPWNVAQEKAHLLSLVDLMQREGGPSQVGDALAFAVRYVTSQIHGARPGASKAVVILIMDTSLDSVDTAADAATSNRVAVFPIGVGDRYDEAQLRILAGPGANSNVVKFQQVEDLPTLVTLGNSFFHKLCSGFSGVCVDEDGNEKKPGDVWTLPDQCHTVTCLPNGQTLLQSHRVNCDHGPRPSCSNNQSPIRVEETCGCRWTCPCVCTGSSTRHIVTFDGQNFKLTGNCSYVLFRNTEQDLEVILHNGACSPGAMQACMKSIEVKHAGLSVGLHSDMEMAVNGRLVPAPYVGGDMEVSIYGAIMYEVRFNHLGHILTFTPQNNEFQLQLSPKTFASKMYGLCGICDENGANDFMLRDGTVTTDWKRLIQEWTVPQPGHTCQPVPEEQCPVSESSRCQVLLSALFAECHKVLAPATFHAICQQDSCHQERVCEVIASYAHLCRTNGVCVDWRTPDFCALSCPPSLVYNHCERGCPRHCDGNTSSCGDPPSEGCFCPQHQVMLDGSCVPEEACTQCVGEDGVRHQFLETWVPDHQPCQICVCLSGRKVNCTAQPCPTARAPTCGPCEVARLKESANRCCPEYECVCDLVNCNLPPVPPCEGGLQPTLTNPGECRPTFTCACRKEECKRVSPPTCPPHRTPTLRKTQCCDEYECACSCANSTVSCPLGYLASVTTNDCGCTTTTCLPDKVCVHRGTIYPVGQFWEEGCDTCTCTDMEDAVMGLRVAQCSQKPCEDSCQPGFSYVIREGECCGRCLPSACKVLAGSLRGDSHSAWKSVGSRWAVPENPCLVNECVRVEEAVFVQQRNISCPQLAVPTCPTGFQLSCENSACCPSCHCEPVEACLLNGTIIGPEKSVMVDLCTTCRCVVQTGAISRFKLECRKTTCAACPTGYREEKNQGECCGRCLPTACTIQLRGGQIMTLKRDETLQDGCDSHFCKVNERGEYIWEKRVTGCPPFDEHRCLAEGGKIMKIPGTCCDTCEEPDCKDITAKLQYVKVGDCKSQEQVDIHYCQGKCASKAVYSIDIEDVQEQCSCCWPSRTEPMRVPLHCANGSVVYHEVINAMQCRCSPRKCSK

SEQ ID NO: 119 - protein, 2813 aa, Macaca fascicularis
MIPARLAGVLLALALVLPGTLCAEGTRGRSSMARCSLFGSDFINTFDGSMYSFAGYCSYLLAGDCQKRSFSIIGDFQNGKRVSLSVYLGEFFDIHLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAGGLECTCPAFLEYTRTCAQEGMVLYGWTDHSACSPVCPAGMEYKQCVSPCARTCQSLHINEVCQERCVDGCSCPEGQLLDEGLCVESTECPCMHSGKRYPPGASLSRDCNTCICRNSQWICSNEECPGECLVTGQSHFKSFDNRYFTFSGICQYLLARDCQDHSFSIVIETVQCADDPDAVCTRSVTVRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECSEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPSMVRHENRCVALERCPCLHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKAISVVWDRHLSISVVLKQTYQEKVCGLCGNFDGIQNNDLTSSNLQVEEDPVDFGNSWKVSSQCADTRKVPLDSSPATCHNNLMKQTMVDSSCRILTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACEEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLIEKQSPENKAFVLSGVDELEQQRDEIVSYLCDLAPEAPPPTLPPDMAQVTVGSGLLGVSTLGPKRNSMVLDVAFVLEGSDKIGEADFNRSKEFMEEVIQRMDVGQDGIHVTVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVAPEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLESHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHAALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCRTNGVCVDWRTPDFCAMSCPPSLVYNPCERGCPRHCNGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPSGFQLSCKTSACCPSCRCEPVEACMLNGTMIGPGKSVMIDACTTCRCIVQVGIISGFKLECRKTICNPCPLGYKEENNTGECCGRCLPTVCTIRLRGGQIMTLKRDETLQDGCDTHFCKVNERGEYFWEKRVTGCPPFDEHKCLAEGGKIKKIPGTCCDTCEEPECSDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 120 - protein, 2824 aa, Macaca fascicularis
MPCQRKVAALLMIPARLAGVLLALALVLPGTLCAEGTRGRSSMARCSLFGSDFINTFDGSMYSFAGYCSYLLAGDCQKRSFSIIGDFQNGKRVSLSVYLGEFFDIHLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAGGLECTCPAFLEYTRTCAQEGMVLYGWTDHSACSPVCPAGMEYKQCVSPCARTCQSLHINEVCQERCVDGCSCPEGQLLDEGLCVESTECPCMHSGKRYPPGASLSRDCNTCICRNSQWICSNEECPGECLVTGQSHFKSFDNRYFTFSGICQYLLARDCQDHSFSIVIETVQCADDPDAVCTRSVTVRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECSEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPSMVRHENRCVALERCPCLHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKAISVVWDRHLSISVVLKQTYQEKVCGLCGNFDGIQNNDLTSSNLQVEEDPVDFGNSWKVSSQCADTRKVPLDSSPATCHNNLMKQTMVDSSCRILTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACEEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLIEKQSPENKAFVLSGVDELEQQRDEIVSYLCDLAPEAPPPTLPPDMAQVTVGSGLLGVSTLGPKRNSMVLDVAFVLEGSDKIGEADFNRSKEFMEEVIQRMDVGQDGIHVTVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVAPEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLESHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHAALSVELHSDMEVTVNGRLVSVPYVGGNMEVNVYGAIMHEVRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCRTNGVCVDWRTPDFCAMSCPPSLVYNPCERGCPRHCNGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPSGFQLSCKTSACCPSCRCEPVEACMLNGTMIGPGKSVMIDACTTCRCIVQVGIISGFKLECRKTICNPCPLGYKEENNTGECCGRCLPTVCTIRLRGGQIMTLKRDETLQDGCDTHFCKVNERGEYFWEKRVTGCPPFDEHKCLAEGGKIKKIPGTCCDTCEEPECSDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 121 - protein, 2815 aa, Myotis brandtii
MIPARLARVLLALVLTLPGTLCAEGSLGRSPMARCSLFGDDFISTFDESMYSFAGDCSYLLAGDCQKHSFSLIGDFQNGKRVSLSVYLGEFFDIHLFVNGTVLQGDQSVSMPYASKGLYLETEAGYYKLSSEAYGFAARIDGSGSIQILLSDRYSNKTCGLCGNFNIFAEDDFRTQEGSLTSDPYDFANSWAMSSGEQRCKRASPPSSSCNASEEMQGLWEQCQLLKRDSVFTRCHPLVDPEPFVALCERTLCTCTQGLRCPCAALLEYARACAHQGMVLYGWTEHSECRPACPAGMEYKECVSPCTRTCQSLKINEVCQEQCVDGCSCPEGQLLDEGRCVESTECSCVHSGKRYPPGASLSRDCNTCICRNSLWICSNEECPGECIITGQSHFKSFDDRYFTFSGVCQYLLARDCQDHSFSIVIETVQCADDPDAVCTRSVTARLPSLHNSLVKLKHGGGIAIDGQDVQLPLLQGDLRIQHTVMASVRLSYGEDLQMDWDGRGRLLVKLSPVYAGRTCGLCGNFNGNKGDDFRTPAGLVEPLVEDFGNAWKLHADCADLRQQHSDPCKLNPRLAKFAEEACSLLTSPKFEACHHAVGPLPYLQNCHYDVCSCSDGRDCLCSAVANYAAACARKGVHVAWREPSFCALSCPQGQVYLQCGTPCNMTCRSLSYPDEECTELCLEGCFCPPGLYLDERGDCVPKSQCPCYYDGEIFQPEDIFSDHHTMCYCEDGFMHCSMSGAPGSLLPQHIVLSGPLGPLSHRSKRSLSCRPPMVKLVCPADNPRAEGLECAKTCQNYDLECMSMGCVSGCLCPPGMVRHENRCVALERCPCFHQGKEYAPGETVKINCNTCVCRDRKWNCTDHVCDATCSTIGVAHYLTFDGLKYMFPGECQYVLVQDYCGSNPGTFRILVGNEGCGYPSVKCKKRVTILVEGGEIELFDGEVNVKRPMKDETHFEVVESGRYIILLLGKALSVVWDHHLTISVVLKETYQEQVCGLCGNFDGVQNNDFTGSNLQVEEDPVDFGNSWKVSPQCADTRKVPLDSSPATCHNNIMKQSMVDSSCRILTSDLFQDCNKLVDPEPFLDVCIYDTCSCESIGDCACFCDTIAAYAHVCAQHGKVVTWRTATLCPQNCEERNIRENGYECEWRYNSCAPACPITCQHPEPLACPVQCVEGCHAHCPPGKILDELLQTCVDPGDCPVCEVSGRRLAPGKKVTLNPGDPEHCQICHCDGVNLTCEACREPEGLEVPPTEGPVSPTTPYVEDTPEPPLHDFFCSKLLDLVFLLDGSSKLSAAEFEVLKVFVVDMMERLHISQKRIRVALVEYHEGSHAYIQLRDRKRPSEMRRLASQVKYAGSAVASTSEVLKYTLFQIFGKIDRPEASRIALLLTASQEPQKLGRNLVRYVQGLKKKKVIVVPVGIGPHANLKQIRLIEKQAPENKAFVLSSVDELEQQRDEIINYLCDLAPEAPAPTQPPPMAQVTVGPEHLAVSTLGPKRNSMVLDVVFVLEGSDQIGEANFNRSKEFLEAVIRRMDVGQESIHVSVLQYSYTVTVETTFRETQSKQDVLQRVREIRYQGGNSTNTGLALQYVSEHTFSASLGDREQAPNLVYMVTANPASDVIKRMPGDIQVVPIGVGPHANVPELERIGWPNEPILIQDFEMLPREAPDLVLQRCCSGEGLQIPTLSPAPDCSQPLDVILLLDGSSGFPASYFDEMKSFAKAFISKANIGPQLTHVSVLQYGSITTVDVPWNVAQEKTQLLGLVDQMQQEGGPSQIGDALGFAVRYITSEGHGARPGTSKAVVILVMGASTDSVTAAAEAARSNRVTVFPIGIGDRYDPAQLKILAGPGASSNVVKLQHIEDLPTIVTLGSSFLHKLCSGYIGVCMDEDGNEKRPGDVWTLPDQCHTVTCLADGQTLLNSHRVNCERGPKPSCPNSQSPVRVEETCGCRWTCPCVCMGSSTRHIVTFDGQNFKLTGSCSYVLFQNKEQDLELILHNGACSPGARQACMKSIEVKHNGLSVELHSDMEVGVNGILVSVPYMGGDMEVNIYGAIMYEIRFNHLGHIFTFTPQNNEFQLQLSPKTFASKMYGLCGICDENGANDFMLRDGTVTTDWKRLVQDWTVQQPGKTCQPVPEEECPISSTSHCQVLLSALFAECHKVFAPATFYAMCQQDSCHLEQVCEAIASYAHLCRTNGVCVDWRTTDFCAMSCPPSLVYNHCEHGCPRHCEGNSSSCGNHPSEGCFCPSHQVMLEGNCVPEEACTQCVGEDGVRHQFLETWVPDHQPCQICTCLSGRKVNCTSHPCPTARVPTCGPCEVARLHQNADQCCPEYECVCDLVSCDLPPVPHCEGGLQPTLTNPGECRPNFTCACRKEECRRESPPSCPPHRTPTLRKTQCCDEYECACNCVNSTVTCPLGYLSSAITNDCGCTTITCLPDKVCVHRGTVYPIGQLWEEGCDICTCTDMEDAVMGLRVAQCSQKSCEESCQLGFTYVLHEGECCGRCLPSACEVVIGSPRGDSQSYWKDVGSHWASPENPCLINECVRVKEEVFVQQRNVSCPQLDVPTCPVGFQLSCASSECCPTCHCEPVQACMLNGTIIGPGKSMMIDVCTTCHCTAQVGIISGFKLECSKTTCTACPEGYKEENIPGECCWRCLPVACTIQLRGGQIMTLQRDEMFQDGCDSHFCKVNERGEYIWEKRVTGCPPFDEHKCLAQGGKIMKIPGTCCDTCEEPDCKDIIARLQYVKVGSCKSEEEVDIHYCQGKCASKALYSIETEDVQDQCSCCSPTRTEPMQVPLRCTNGSIVYHEVLNAMQCRCSPRKCSK

SEQ ID NO: 122 - protein, 2749 aa, Mus musculus
MHQPLVLTKRNFQDGKRMSLSVYLGEFFDIHLFANGTVTQGDQSISMPYASQGLYLEREAGYYKLSSETFGFAARIDGNGNFQVLMSDRHFNKTCGLCGDFNIFAEDDFRTQEGTLTSDPYDFANSWALSSEEQRCKRASPPSRNCESSSGDMHQAMWEQCQLLKTASVFARCHPLVDPESFVALCEKILCTCATGPECACPVLLEYARTCAQEGMVLYGWTDHSACRPACPAGMEYKECVSPCPRTCQSLSINEVCQQQCVDGCSCPEGELLDEDRCVQSSDCPCVHAGKRYPPGTSLSQDCNTCICRNSLWICSNEECPGECLVTGQSHFKSFDNRYFTFSGICQYLLARDCEDHTFSIVIETMQCADDPDAVCTRSVSVRLSALHNSLVKLKHGGAVGIDGQDVQLPFLQGDLRIQHTVMASVRLSYAEDLQMDWDGRGRLLVKLSPVYSGKTCGLCGNYNGNKGDDFLTPAGLVEPLVVDFGNAWKLQGDCSDLRRQHSDPCSLNPRLTRFAEEACALLTSSKFEACHHAVSPLPYLQNCRYDVCSCSDSRDCLCNAVANYAAECARKGVHIGWREPGFCALGCPQGQVYLQCGNSCNLTCRSLSLPDEECSEVCLEGCYCPPGLYQDERGDCVPKAQCPCYYDGELFQPADIFSDHHTMCYCEDGFMHCTTSGTLGSLLPDTVLSSPLSHRSKRSLSCRPPMVKLVCPADNPRAQGLECAKTCQNYDLECMSLGCVSGCLCPPGMVRHENKCVALERCPCFHQGAEYAPGDTVKIGCNTCVCRERKWNCTNHVCDATCSAIGMAHYLTFDGLKYLFPGECQYVLVQDYCGSNPGTFQILVGNEGCSYPSVKCRKRVTILVDGGELELFDGEVNVKRPLRDESHFEVVESGRYVILLLGQALSVVWDHHLSISVVLKHTYQEQVCGLCGNFDGIQNNDFTTSSLQVEEDPVNFGNSWKVSSQCADTRKLSLDVSPATCHNNIMKQTMVDSACRILTSDVFQGCNRLVDPEPYLDICIYDTCSCESIGDCACFCDTIAAYAHVCAQHGQVVAWRTPTLCPQSCEEKNVRENGYECEWRYNSCAPACPVTCQHPEPLACPVQCVEGCHAHCPPGRILDELLQTCVDPQDCPVCEVAGRRLAPGKKITLSPDDPAHCQNCHCDGVNLTCEACQEPGGLVAPPTDAPVSSTTPYVEDTPEPPLHNFYCSKLLDLVFLLDGSSMLSEAEFEVLKAFVVGMMERLHISQKRIRVAVVEYHDGSRAYLELKARKRPSELRRITSQIKYTGSQVASTSEVLKYTLFQIFGKIDRPEASHITLLLTASQEPPRMARNLVRYVQGLKKKKVIVIPVGIGPHASLKQIRLIEKQAPENKAFLLSGVDELEQRRDEIVSYLCDLAPEAPAPTQPPQVAHVTVSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPTLPPLPDCSQPLDVVLLLDGSSSLPESSFDKMKSFAKAFISKANIGPHLTQVSVIQYGSINTIDVPWNVVQEKAHLQSLVDLMQQEGGPSQIGDALAFAVRYVTSQIHGARPGASKAVVIIIMDTSLDPVDTAADAARSNRVAVFPVGVGDRYDEAQLRILAGPGASSNVVKLQQVEDLSTMATLGNSFFHKLCSGFSGVCVDEDGNEKRPGDVWTLPDQCHTVTCLANGQTLLQSHRVNCDHGPRPSCANSQSPVRVEETCGCRWTCPCVCTGSSTRHIVTFDGQNFKLTGSCSYVIFQNKEQDLEVLLHNGACSPGAKQACMKSIEIKHAGVSAELHSNMEMAVDGRLVLAPYVGENMEVSIYGAIMYEVRFTHLGHILTYTPQNNEFQLQLSPKTFASKMHGLCGICDENGANDFTLRDGTVTTDWKRLVQEWTVQQPGYTCQAVPEEQCPVSDSSHCQVLLSASFAECHKVIAPATFHTICQQDSCHQERVCEVIASYAHLCRTSGVCVDWRTTDFCAMSCPPSLVYNHCERGCPRHCDGNTSFCGDHPSEGCFCPQHQVFLEGSCVPEEACTQCVGEDGVRHQFLETWVPDHQPCQICMCLSGRKINCTAQPCPTARAPTCGPCEVARLKQSTNLCCPEYECVCDLFNCNLPPVPPCEGGLQPTLTNPGECRPTFTCACRKEECKRVSPPSCPPHRTPTLRKTQCCDEYECACSCVNSTLSCPLGYLASATTNDCGCTTTTCLPDKVCVHRGTVYPVGQFWEEGCDTCTCTDMEDTVVGLRVVQCSQRPCEDSCQPGFSYVLHEGECCGRCLPSACKVVAGSLRGDSHSSWKSVGSRWAVPENPCLVNECVRVEDAVFVQQRNISCPQLAVPTCPTGFQLNCETSECCPSCHCEPVEACLLNGTIIGPGKSVMVDLCTTCRCIVQTDAISRFKLECRKTTCEACPMGYREEKSQGECCGRCLPTACTIQLRGGRIMTLKQDETFQDGCDSHLCRVNERGEYIWEKRVTGCPPFDEHKCLAEGGKIVKIPGTCCDTCEEPDCKDITAKVQYIKVGDCKSQEEVDIHYCQGKCASKAVYSIDIEDVQEQCSCCLPSRTEPMRVPLHCTNGSVVYHEVINAMQCRCSPRNCSK

SEQ ID NO: 123 - protein, 2824 aa, Chlorocebus sabaeus
MPCQRKVAGLLMIPARFAGVLLALALILPGTLCAEGTRGRSSMARCSLFGSDFINTFDGSMYSFAGYCSYLLAGDCQKRSFSIIGDFQSGKRVSLSVYLGEFFDIRLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEMQKGLWEQCQLLKSTSVFARCHPLVDPEPFVALCEKTSCECAGELECTCPAFLEYARTCAQEGMVLYGWTDHSACSPVCPAGMEYKQCVSPCTRTCQSLHVNEVCQERCVDGCSCPEGQLLDEGLCVESTECPCMHSGKRYPPGASLSRDCNTCICRNSQWICSNEECPGECLVTGQSHFKSFDNRYFTFSGICQYLLARDCQDHSFSIVIETVQCADDPDAVCTRSATVRLPGLHNSLVKLKHGGGVAMDGQDVQLPLLKGDLRIQHSVTASVRLSYGEDLRMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNLMKQTMVDSSCRILTSDVFQDCNKLVDPEPFLDICIYDTCSCESIGDCACFCDTIAAYAHVCAQHGKLVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACEEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLVEKQSPENKAFVLSGVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYTVAVEYPFSEAQSKGDILQRVREIRYQGGNRTNTGLALQYLSEHSFLASQGDREQAPNLVYMVTGNPASDEIKRLPGDIQVVPIGVGPHASVRELERIGWPNAPILIQDFETLPREAPDLVLQSCCSGEGLKIPTLSPAPDCSQPLDVILLLDGSSSFPASYFDEMKSFAKAFISKANIGPHLTQVSVLQYGSITTIDVPWNAALEKAHLLSLVDVMQREGGPSQIGDALGFAVRYLTSEIHGARPGASKAVVILVMDVSVDSVDAAADAARSNRVTVFPIGIGDRYDAAQLRILAGPAGNSNVVKLQRIEDLPTMVTLGNSFLHKLCSGFVRICMDEDGNEKKPGDIWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHGALSVELHSDMEVTVNGRLVSVPYVGGNMEVNVYGAIMHEIRFNHLGHIFTFTPQNNEFQLQLSPKTFASKMYGLCGICDENGANDFMLRDGTVTTDWKTLVQEWTVQRPGQTCQPILEEQCLVPNSSQCQVLLSAPFAECHKVLAPATFYAICQQDSCHRQQVCEVIASYAHLCRTNGVCVDWRTPDFCAMSCPPSLVYNPCERGCPRHCDGNVSSCGDHPSEGCFCPPNKVMLEGSCVPEEACTQCIGEDGVQHQFLEAWVPDHQPCQICTCLSGRKANCTVQPCPTAKAPTCGLCEVARLRQNADQCCPEYECVCDPESCDLPPVPHCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACKVVTGSPRGDSQSSWKSVGSHWASPENPCLINECVRVKEEVFVQQRNVSCPQLEVPVCPSGFQLSCKTSACCPSCHCEPVEACMLNGTMIGPGKSVMIDACTTCRCIVQVGIISGFKLECRKTICNPCPLGYKEENNTGECCGRCLPTACTIRLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNALQCECSPRKCSK

SEQ ID NO: 124 - protein, 2913 aa, Chlorocebus sabaeus
MLIDGRLEKKNGSLKGKETGCWGSSLPWGLPPVVSQHLGCSCLTSGALVLMMELKQSLHAMPEESRWAAETFLLLHALTIATPATYLGSNDQLTSLPCLQMIPARFAGVLLALALILPGTLCAEGTRGRSSMARCSLFGSDFINTFDGSMYSFAGYCSYLLAGDCQKRSFSIIGDFQSGKRVSLSVYLGEFFDIRLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEMQKGLWEQCQLLKSTSVFARCHPLVDPEPFVALCEKTSCECAGELECTCPAFLEYARTCAQEGMVLYGWTDHSACSPVCPAGMEYKQCVSPCTRTCQSLHVNEVCQERCVDGCSCPEGQLLDEGLCVESTECPCMHSGKRYPPGASLSRDCNTCICRNSQWICSNEECPGECLVTGQSHFKSFDNRYFTFSGICQYLLARDCQDHSFSIVIETVQCADDPDAVCTRSATVRLPGLHNSLVKLKHGGGVAMDGQDVQLPLLKGDLRIQHSVTASVRLSYGEDLRMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNLMKQTMVDSSCRILTSDVFQDCNKLVDPEPFLDICIYDTCSCESIGDCACFCDTIAAYAHVCAQHGKLVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACEEPGGLVVPPTDAPVSPTTLYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLVEKQSPENKAFVLSGVDELEQQRDEIVSYLCDLAPEAPPPTLPPDMAQVTVGPGLLGVSTLGPKRNSMVLDVAFVLEGSDKIGEADFNRSKEFMEEVIQRMDVGQDSIHVTVLQYSYTVAVEYPFSEAQSKGDILQRVREIRYQGGNRTNTGLALQYLSEHSFLASQGDREQAPNLVYMVTGNPASDEIKRLPGDIQVVPIGVGPHASVRELERIGWPNAPILIQDFETLPREAPDLVLQSCCSGEGLKIPTLSPAPDCSQPLDVILLLDGSSSFPASYFDEMKSFAKAFISKANIGPHLTQVSVLQYGSITTIDVPWNAALEKAHLLSLVDVMQREGGPSQIGDALGFAVRYLTSEIHGARPGASKAVVILVMDVSVDSVDAAADAARSNRVTVFPIGIGDRYDAAQLRILAGPAGNSNVVKLQRIEDLPTMVTLGNSFLHKLCSGFVRICMDEDGNEKKPGDIWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHGALSVELHSDMEVTVNGRLVSVPYVGGNMEVNVYGAIMHEIRFNHLGHIFTFTPQNNEFQLQLSPKTFASKMYGLCGICDENGANDFMLRDGTVTTDWKTLVQEWTVQRPGQTCQPILEEQCLVPNSSQCQVLLSAPFAECHKVLAPATFYAICQQDSCHRQQVCEVIASYAHLCRTNGVCVDWRTPDFCAMSCPPSLVYNPCERGCPRHCDGNVSSCGDHPSEGCFCPPNKVMLEGSCVPEEACTQCIGEDGVQHQFLEAWVPDHQPCQICTCLSGRKANCTVQPCPTAKAPTCGLCEVARLRQNADQCCPEYECVCDPESCDLPPVPHCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACKVVTGSPRGDSQSSWKSVGSHWASPENPCLINECVRVKEEVFVQQRNVSCPQLEVPVCPSGFQLSCKTSACCPSCHCEPVEACMLNGTMIGPGKSVMIDACTTCRCIVQVGIISGFKLECRKTICNPCPLGYKEENNTGECCGRCLPTACTIRLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNALQCECSPRKCSK

SEQ ID NO: 125 - protein, 2815 aa, Eptesicus fuscus
MIPARLARVLLALVLTLPGTLCAEGSLGRSPMARCSLFGDDFISTFDESMYSFAGDCSYLLAGDCQKHSFSLIGDFQNGKRVSLSVYLGEFFDIHLFVNGTVLQGDQSVSMPYASKGLYLETEAGYYKLSSEAYGFVARIDGSGSFQILLSDRYFNKTCGLCGNFNIFAEDDFRTQEGSLTSDPYDFANSWAMSSGEQRCKRASPPTSPCNVSEEMQGPWEQCQLLKRASVFARCHPLVDPEPFVALCERTLCTCTQGLKCPCAALLEYARACAHQGMVLYGWTEHSECRPACPAGMEYKECVSPCTRTCQSLKINEVCQEQCVDGCSCAVGQLLDEGRCVESTECSCVHSGKRYPPGASLSRDCNTCICRNSLWICSNEECPGECLITGQSHFKSFDDRYFTFSGVCQYLLARDCQDHSFSIVIETVQCADDPDAVCTRSVTARLPSLHNSLVKLKHGGGVAIDGQDVQIPLLQGDLRIQHTVMASVRLSYGEDLQMEWDGRGRLLVKLSPVYAGRTCGLCGNFNGNKGDDFRTPAGLVEPLVEDFGNAWKLHPDCADLRQQHSDPCKLNPRLAKFAEAACSLLTSPKFEACHHAVGPLPYLQNCHYDVCSCSDGRDCLCSAVANYAAACARKGVHVAWREPSFCALSCPQGQVYLQCGTPCNMTCRSLSYPDEECTELCLEGCFCPPGLYLDERGDCVPKAQCPCYYDGEIFQPEDIFSDHHTMCYCEDGFMHCSTSGAPGSLLPQHIVLSGPLGPLPHRSKRSLSCRPPMVKLVCPADNPRAEGLECAKTCQNYDLECMSMGCVSGCLCPPGMVRHENRCVALERCPCFHQGKEYAPGETVKINCNTCVCRDRKWNCTDHVCDATCSTIGMAHYLTFDGLKYMFPGECQYVLVQDYCGSNPGTFRILVGNEGCGYPSVKCKKRVTILVEGGEIELFDGEVNVKRPMKDETHFEVVESGRYIILLLGKALSVVWDHHLSISVVLKQTYQEQVCGLCGNFDGIQNNDFTGSNLQVEEDPVDFGNSWKVSPQCADTRKVPLDLSPATCHNNVMKQSMVDSSCRILTSDLFQECNKLVDPEPFLDVCIYDTCSCESIGDCACFCDTIAAYAHVCAQHGKVVTWRTTTLCPQNCEERNLRENGYECEWRYNSCAPACPTTCQHPEPLACPVQCVEGCHAHCPPGKILDELLQTCVDPRDCPVCEVSGRRLAPGKKVTLNPGDPEHCQICHCDGVNLTCEACREPGGLEVPPTEGPISPTTPYVEDTPEPPLHDFFCSKLLDLVFLLDGSSKLSPAEFEVLKAFVVDMMERLHISQKRIRVALVEYHEGSHAYIQLRDRKRPSEMRRLASQVKYAGSAVASTSEVLKYTLFQIFGKIDRPEASRIALLLMASQEPQKLGRNLVRYVQGLKKKKVIVVPVGIGPHASLKQIRLIEKQAPENKAFVLSSVDELEQQRDEIINYLCDLAPEAPAPTQPPPMAQVTVGPEHLGVSTLGPKRNSMVLDVVFVLEGSDLIGEANFNRSKEFMEEVIRRMDVGQESIHITVLQYSYTVTEETTFRETQSKRDVLQRVREIRYQGGNSTNTGLALQYVSEHTFSASLGDREQAPNLVYMVTGNPASDEIKRMPGDIQVVPIGVGPHANVQELERIGWPNVPILIQDFETLPREAPDLVLQRCCSGEGLQIPTLSPTPDCSQPLDVVLLLDGSSGFPASYFDEMKSFAKAFISKANIGPQLTHVSVLQYGSITTIDVPWNVAQEKTHLLGLVDHMQQEGGPSQIGHALGFAVQYITSEVHGARPGASKAVVILTMGTSTDSVAAAAEAARSNRVTVFPIGIGDRYDPAQLRILAGPDASSNVVKLQRIEDLPTMVTLGNSFLHKLCSGYVRVCMDEDGNEKRPGDVWTLPDQCHTVTCLPDGQTLLNSHRVNCDRVPRPSCPNSQSPVRMEETCGCRWTCPCVCMGSSTRHIVTFDGQNFKLTGSCSYVLFQNKEQDLELILHNGACSPGARQACMKSIEVKHNGLSVELHSDMEVGVNGILVSVPYTGGDMEVNIYGAIMYEIRFNHLGHIFTFTPQNNEFQLQLSPKTFASKMYGLCGICDENGANDFMLRDGTVTTDWKRLVQDWTVQQPGRMCQPVPEEECPISSTSHCQVLLSALFAECHKVFAPATFYAMCQQDSCHPEKVCESIASYAHLCRTNGVCVDWRTADFCAMSCPPSLVYNHCEHGCPRHCEGNSSSCGNHPSEGCFCPSHQVMLEGSCVPEEACTQCVGEDGVRHQFLETWVPDHQPCLICMCLSGRKVNCTSHPCPTARVPTCGPCEVARLHQNADQCCPEYECVCDSESCDLPPVPHCEGGLQPTLTNPGECRPNFICACRKEECRRESPPSCPPHRTPTLRKTQCCDEYECACNCVNSTVTCPLGYLSSAVTNDCGCTTITCLPDKVCVHRGTVYPIGQLWEEGCDICTCTDMEDAVMGLRVAQCSQKPCEESCQLGFTYILQEGECCGRCLPNACEVVIGSPRGDSQSYWKDVGSHWASPENPCLINECVRVKEEVFVQQRNVSCPQLDVPTCPVGFQLSCASSECCPTCHCEAVEACMLNGTIIAPGTSMMIDVCTTCHCTAQVGIISGFKLECSKTTCAACPQGYKEEKIPGECCWRCLPVACTIQLRGGQIMTLKRDEMFQDGCDSHFCKVNERGEYIWEKRVTGCPPFDEHKCLAQGGKIMKIPGTCCDTCEEPDCKDITAKLQYVKVGSCKSEEQVDIHYCQGKCASKALYSIETEDVQDQCSCCSPTRTEPMQVPLRCTNGSIVYHEVLNAMQCRCSPRKCSK

SEQ ID NO: 126 - protein, 2810 aa, Rhinopithecus roxellana
MIPARFARVLLAVALVLPGTLCAEGTRGRSSMARCSLFGSDFINTFDGSMYSFAGYCSYLLAGDCQKRSFSIIGDFQSGKRVSLSVYLGEFFDIHLFVNGTVTQGDKRVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEMQKGLWEQCQLLKSTSVFARCHPLVDPEPFVALCEKTSCECAGGLECTCPAFLEYARTCAQEGMVLYGWTDHSACSPVCPAGMEYKQCVSPCARTCQSLHVNEVCQERCMDGCSCPEGQLLDEGLCVESTECPCMHSGKRYPPSASLSRDCNTCICRNSQWICSNEECPGECLVTGQSHFKSFDNRYFTFSGICQYLLARDCQDHSFSIVIETVQCADDPDAVCTRSVTVRLPGLHHSLVKMKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRPCLLKKTSPTFEACHRAVSPLPYLRNCRYDVCSCSDGRECLCGALASYAAACAGKGVRVAWREPGRCELKCPKGQVYLQCGNPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGSNPGTFRILVGNEGCSHPSVKCKKHVTILVEGGEIELFDGEVNVKRPMKDETHFEVVESGRYIILLLGKALSVVWDHHLSISVVLKQTYQEKVCGLCGNFDGVQNNDLTSSNLQVEEDPVEFGNSWKVSSQCADTRKVPLDSSPATCHNNLMKQTMVDSSCRILTSDVFQDCNKLVDPEPFLDVCIYDTCSCESTGDCACFCDTVAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNFTCEACEEPRGLVVPPTDAPVSPTTPYVEDISEAPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIVLLLMASQEPQRMSRNFVRYVQGLKKKKVIIIPVGIGPHANLKQIRLVEKQSPENKAFVLSGVDELEQQRDEIVSYLCDLAPAAPPPTLAPDMAQVTAGPGLLGVSTLGLKRNSMVLDVAFVLEGSDNIGEADFNRSKEFMEEVIQRMDVGQDGIHVTVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPPPDCSQPLDVILLLDGSSSFPASYFDEMKSFAKAFISKANIGPHLTQVSVLQYGSITNIDVPWNVALEKAHLLSLVDVMQREGGPSQIGDALGFAVRYLTSEMHGARPGASKAVVILVMDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHSALSVELHSDMEVTVNGRLVSVPYVGGNMEVNVYGAIMHEIRFNHLGHIFTFTPQNNEFQLQLSPKTFASKTYGLCGICDENGANDFMLRDGTVTTDWKALVQEWTVQRPGQTCRPILEEQCLVPNSSQCQVLLSALFAECHKVLAPATFYAICQQDSCHREQVCEVIASYAHLCRTNGICVDWRTPDFCAMSCPPSLVYNPCERGCPRHCDGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGLQPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVLHEGECCGRCLPSACEVVTGSPRGDSQSSWKSVGSHWASPENPCLINECVRVKEEVFVQQRNVSCPQLEVPVCPSGFQLSCKTSACCPSCRCEPVEACMLNGTMIGPGKSVMIDACTTCRCTVQVGIISGFKLECRKTTCNPCPLGYKEENNTGECCGRCLPTACTIRLRGGQILTLKRDETLQDGCDTHFCKVNERGEYFWEKRVTGCPPFDEHKCLAEGGKIMKIPGTCCDTCEQPECNDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 127 - protein, 2812 aa, Cercocebus atys
MIPARLAGMLLALALVLPGTLCAEGTRGRSSMARCSLFGSDFINTFDGSMYSFAGYCSYLLAGDCQKRSFSIIGDFQNGKRVSLSVYLGEFFDIHLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISGEVQKGLWEQCQLLKSTSVFARCHPLVDPEPFVALCEKTSCECAGGLECTCPAFLEYARTCAQEGMVLYGWTDHSACSPVCPAGMEYKQCVSPCARTCQSLHINEVCQERCVDGCSCPEGQLLDEGVCVESTECPCMHSGKRYPPGASLSRDCNTCICRNSQWICSNEECPGECLVTGQSHFKSFDNRYFTFSGICQYLLARDCQDHSFSIVIETVQCADDPDAVCTRSVTVRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHGDCQDLQKQHGDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDRVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYVILLLGKALSVVWDRHLSISVVLKQTYQEKVCGLCGNFDGIQNNDLTSSNLQVEEDPADFGNSWKVSSQCADTRKVPLDSSPATCHNNLMKQTMVDSSCRILTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACEAPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLVEKQSPENRAFVLSGVDELEQQRDEIVSYLCDLAPEAPPTTLPPDMAQVTVGPGLLGVSTLGPKRNSMVLDVAFVLEGSDKIGEADFNRSKEFMEEVIQRMDVGQDGIHVTVLQYSYTVAVEYPFSEAQSKGDILQRVREIRYQGGNRTNTGLALQYLSDHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVALEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLMSHRVNCDRGLKPSCPNSQSPVKVEETCGCRWTCPCVCTGSSTRHIVTFDGQNFKLTGSCSYVLFQNKEQDLEVILHNGACSPAARQGCMKSIEVKHGALSVELHSDMEVTVNGRLVSVPYVGGNMEVNVYGAIMHEIRFNHLGHIFTFTPQNNEFQLQLSPKTFASKTYGLCGICDENGANDFMLRDGTVTTDWKTLVQEWTVQRPGQTCQPILEEQCLVPNSSRCQVLLSALFAECHKVLAPATFYAICQQDSCHREQVCEVIASYAHLCRTNGVCVDWRTPDFCAMSCPPSLVYNPCERGCPRHCDGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGLQPTLTNPGECRPSFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPSGFQLSCKTSACCPSCHCEPVEACMLNGTMIGPGKSVMIDACTTCRCTVQVGIISGFKLECRKTICNPCPLGYKEEKNTGECCGRCLPTTCTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 128 - protein, 2813 aa, Mandrillus leucophaeus
MIPARLPGVLLALALVLPGTLCAEGTRGRSSMARCSLFGSDFINTFDGSMYSFAGYCSYLLAGDCQKRSFSIIGDFQNGKRVSLSVYLGEFFDIHLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAGGLECTCPAFLEYARTCAQEGMVLYGWTDHSACSPVCPAGMEYKQCVSSCARTCQSLHINEVCQERCVDGCSCPEGQLLDEGLCVESTECPCMHSGKRYPPGASLSRDCNTCICRNSQWICSNEECPGECLVTGQSHFKSFDNRYFTFSGICQYLLARDCQDHSFSIVIETVQCADDPDAVCTRSVTVRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGGNPGTFRILVGNEGCSHPSVKCKKHVTILVEGGEIELFDGEVNVKRPMKDETHFEVVESGRYIILLLGKALSVVWDRHLSISVVLKQTYQEKVCGLCGNFDGIQNNDLTSSNLQVEEDPADFGNSWKVSSQCADTRKVPLDSSPATCHNNLMKQTMVDSSCRILTGDVFRDCNKLVDPEPFLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACEEPGGLVVPPTDAPVSPTTPYVEDISEPPLHDFYCSRLLDLVFLLDGSSRLSEAEFEVLKAFVVDMMERLRISQKWVRVAVVEYHDGSHSYIGLKDRKRPSELRRIASQVKYAGSQVAFTSEVLKYTLFQIFGKIDRPEASRIALLLMASQEPQRMSRNFVRYVQGLKKKKVIVIPVGIGPHANLKQIRLVEKQSPENKAFVLSGVDELEQQRDEIVSYLCDLAPEAPPPTLPPDMAQVTVGPGLLGVSTLGPKRNSMVLDVAFVLEGSDKIGEADFNRSKEFMEEVIQRMDVGQDGIHVTVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVALEKAHLLSLVDVMQREGGPSQIGDALGFAVRYLTSEMHGARPGASKAVVILVMDVSVDAVDAAADAARSNRVAVFPIGIGDRYDAAQLRILAGPAGNSNVVKLQRIEDLPTMVTLGNSFLHKLCSGFVRICMDEDGNERRPGDIWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHGALSVELHSDMEVTVNGRLVSVPYVGGNMEVNVYGAIMHEIRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCRTNGVCVDWRTPDFCAMSCPPSLVYNPCERGCPRHCDGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGLQPTLTNPGECRPNFTCACRKEECKRVSPPSCPPHRLPALRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPSGFQLSCKTSACCPSCHCEPVEACMLNGTMIGPGKSVMIDACTTCRCTVQVGIISGFKLECRKTICNPCPLGYKEENNTGECCGRCLPTTCTIQLRGGQIMTLKRDETLQDGCDTHFCKVNERGEYFWEKRVTGCPPFDEHRCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 129 - protein, 2348 aa, Nomascus leucogenys
MDGQDVQLPLLKGDLRIQHTVTASVHLSHGEDLQLDWDGRGRLLVKLSPVYAGKTCGLCGNYNGNQGDDFITPSGLAEPRVEDFGNAWKLHGNCQDLQKQHSDPCALNPRMTRFSEEACAVLTSPTFEACHRAVSPLPYLRNCRYDVCSCSDGRECLCGALASYAAACAGRGVRVAWRQPDRCELNCPKGQVYLQCGTPCNLTCRSLSYPDEECNEACLEGCFCPPGLYMDERGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGETVKIGCNTCVCRDRKWNCTDHVCDATCSTIGMAHYLTFDGLKYMFPGECQYVLVQDYCGSNPGTFRVLVGNEGCSHPSVKCKKRVTILVEGGEIELFDGEANVKRPMKDETHFEVVESGRYIILLLGKALSVVWDRHLSISVVLKQTYQEKVCGLCGNFDGIQNNDLTSSNLQVEEDPVDFGNSWKVSSQCADTRKVPLDSSPATCHNNIMKQTMVDSSCRILTSDVFQDCNKLVDPEPYLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEVAGRRFAPGKKVTLNPSDPEHCQICHCDGVNLTCEACQEPGGLVVPPTDAPVSPTTPYVEDTWEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLVEKQAPENKAFVLSGVDELEQQRDEIVSYLCDLAPEAPPPTLPPNMAQVTVGPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALQYLSDHSFLVSQGDREQAPNLVYMVTGNPASDEIKRLPGDIQVVPIGVGPNANVQELERIGWPNAPILIQDFETLPREAPDLVLQRCCSGEGLQIPTLSPASDCSQPLDVIFLLDGSSSFPASYFDEMKSFAKAFISKANIGPHLTQVSVLQYGSITTIDVPWNVAPEKAHLLSLVDVMQREGGPSQIGDALGFAVRYLTSEMHGARPGASKAVVILVTDVSVDSVDAAADAARSNRVTVFPIGIGDRYDAAQLRILAGPAGDSNMVKLQRIEDLPTMVTLGNSFLHKLCSGFVRICMDEDGNEKRPGDVWTLPDQCHTVTCQPDGQTLLKSHRVNCDRGPRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVTVNGRLVSVPYVGGNMEVNVYGTIMHEVRFNHLGHIFTFTPQNNEFQLQLSPKTFASKTYGLCGICDENGANDFMLRDGTVTTDWKTLVQEWTVQQPGHTCHPIPEEQCLVPDSSHCQILLLPLFAECHKVLAPATFYAICQQDSCHQEQVCGVIASYAHLCRTNGVCVDWRTPDFCAMSCPPSLVYNHCEHGCPRHCDGNVSSCGDHPSEGCFCPPNKVMLEGSCVPEEACTQCIGEDGVQHQFLEAWVPDHQPCQICTCLSGRKVNCTTQPCPTAKAPTCGLCEVARLRQNADQCCPEYECVCDPVSCDLPPVPHCEGGLQPTLTNPGECRPNFTCACRKEECERVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVAQCSQKPCEDSCRSGFTYVLHEGECCGRCLPSACEVVTGSPRGDSQSFWKSVGSQWASPENPCLINECVRVKEEVFVQQRNVSCPQLEVPACPSGFQLSCKTSVCCPSCRCERVEACMLNGTIIGPGKSVMIDVCTTCRCMVQVGVISGFKLECRKTTCNPCPLGYKEENNTGECCGRCLPTACTIQLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNAMECKCSPRKCSK

SEQ ID NO: 130 - protein, 2711 aa, Peromyscus maniculatus bairdii
MQGDQSIAMPYASKGLYLEAEAGYYKLSSEAYGFVAKIDGDGNFQVLMSNRYFNKTCGLCGDFNVFAEDDFRMQEGALTSDPYDFANSWALSSGEQRCKRASPPGSHCNSSSGDMQKAMWEQCQLLKSASVFARCHPLVDPEPFVALCEKTLCTCTTGPECACPTLLEYARACAQEGMVLYGWTDHSACHPACPAGMEYKECVSPCTRTCQSLPINEVCQQQCVDGCACPEGELLDEGRCVQSSECSCVHAGKRHPPGTSLSQDCNTCICRNSLWICSNEECPGECLVTGQSHFKSFDNKYFTFSGVCQYLLARDCQDHSFSIVIETMQCADDPDAVCTRSAAVRLSALHNSLVKLKHGGGVAIDGQDVQIPFLQGDLRIQHTVMASVHLSYGDDLQMDWDGRGRLLVKLSPVYSGKTCGLCGNYNGNKGDDFLTPAGLVEPLVVDFGNAWKLQGDCPDLQRQPSDPCSLNPRLTRFAEEACALLTSSKFEACHHAVSPLPYLQNCRYDVCSCADGRDCLCSAVANYAAACARKGVHVGWREPDFCALGCPQGQVYLQCGNSCNLTCRSLSYPDEECNDVCLEGCFCPPGLYQDERGDCVPKAQCPCYYDGELFQPADIFSDHHIMCYCEDGFMHCTTSGTPGSLLPDTVLSRPLSHRSKRSLSCRPPMVKLVCPADNPRAQGLECAKTCQNYDLECMSPGCVSGCLCPPGMVRHENKCVALERCPCFHQGQEYAPGDTVKIGCNTCVCRDRRWNCTNHVCDATCSAIGMAHYITFDGLKYLFPGECQYVLVQDYCGGNPGTFRILVGNEGCSYPSVKCKKRVTILVEGGEIELFDGEVNVRKPLKDESHFEMVESGRYVILLLGQALSVVWDHHLSVSVVLKHTHQEKVCGLCGNFDGIQNNDFTSSSLQVEEDPVDFGNSWKVSSQCADTRKLSLDVSPATCHNNIMKQTMVDSSCRILTSDIFQACNRLVDPEPYLDICIYDTCSCESIGDCACFCDTIAAYAHVCAQHGQVVAWRTPALCPQSCEERNVRENGYECEWRYNSCAPACPVTCQHPEPLACPVQCVEGCHAHCPPGRILDELLQTCVDPQDCPVCEVAGRRLAPGKKIILSPDDPAHCQNCHCDGVNLTCEACQEPGGLVVPPTDAPVSATTPYVEDTPEPPLHSFQCSRLLDLVFLLDGSSRLSEAEFEVLKTFVVGMMERLHVSQKRVRVAVVEYHDGSHAYIELKARKRPSELRRIASQVKYAGSQVASTSEVLKYTLFQIFGKIDRPEASRIILLLTASQEPPRMARNLVRYVQGLKKKKVIVIPVGIGPHASLKQIHLIEKQAPENKAFLLSGVDELEQRRDEIINYLCDLAPEPRAPTQPPQVAQITMSLGILGISSPGPKRKSMVLDVVFVLEGSDEVGEANFNKSKEFLEEVIQRMDVGQDGIHITVLQYSYMVTVEYAFNEAQSKEDVLRHVREIRYHGGNRTNTGQALQYLSEHTFSPSQGDREQAPNLVYMVTGNPASDEIRRLPGDIQVVPIGVGPHANAQELERIGWPNAPIFIRDFETLPREAPDLVLQRCCSREGLQLPTLSPIPDCSQALDVVLLLDGSSGSPEPAFDMMKSFVKAFISKANIGPHLTHVSVLQYGSINTIDISWNEAQEKAHLLSLVDLMQREGGPSQIGDALAFAVRYLTSQIHGARPGASKAVVILIMDTSLDSVYSAADAARSNRVAVFPIGVGDRYDEAQLRILAGPGASSNVVKLRQVEDLPAVVTLGNSFFRQLCSGFSGVCVDEDGNEKRPGDVWTLPDQCHTVTCLPNGQTLLQSHRVNCDHGPRPSCSNSQSPVRVEETCGCRWTCPCVCTGSSTRHIVTFDGQNFKLTGNCSYVLFQNKEQDLEVVLHNGACSPRAMQACMKSIEVKHAGLSVELHSDMEMTVNGRLVPAPYVGGNMEVSIYGAIMYEVRFNHLGHILTFTPQNNEFQLQLSPKTFASKMYGLCGICDENGANDFMLRDGTVTTDWKRLIQEWTVQQPGHTCQPVPEEQCPVSDTSHCQVLLSALFAECHKVLAPATFHAICQQDSCHQERVCEVIASYAHLCRTNGVCVDWRTADFCAMSCPPTLVYNHCERGCPRHCDGNTSSCGDHPAEGCFCPQHQVMLEGSCVPEEACTQCVGEDGVRHQFLETWVLEHQPCQICVCLGGRKANCTAQPCPTARAPTCGPCEVARLKESANQCCPEYECVCDLVNCHLPPVPPCEGGLQPTLTNPGECRPTFTCACRKEECRRVSPPSCPPHRTPTLRKTQCCDEYECACSCVNSTVSCPLGYLASATTNDCGCSTTTCLPDKVCVHRGTIYPVGQFWEEGCDTCTCTDMEDTVMGLRVAQCSQKPCEDSCQPGFSYILHEGECCGRCLPSACKVMAGSLRGDSHSSWKSVGSRWPVPENPCLINECVRVEETVFVQQRNISCPQLAIPTCPTGFQLSCEALACCPSCRCEPVEACLLNGTTIGPGKSVMVDFCTTCRCTVQTGAISRFKLECRKTTCEACPVGYREEKNPGECCGRCLPTACTIQLRGGQIVTLKRDETLQDGCDSHFCKVNERGEYIWEKRVTGCPPFDEHKCLAEGGKIMKIPGTCCDTCEEPDCKDIIAKLKYVKVGDCKSQEEVDIHYCQGKCASKAIYSIDIEDVQEQCSCCGPSRTESMHVPLLCTNGSVVHHEVINALQCRCAPRKCSK

SEQ ID NO: 131 - protein, 2811 aa, Miniopterus natalensis
  misc_feature (575)..(575): Xaa can be any naturally occurring amino acid
MIPAGLARVLLALAFTLPGTLCAEGPRGSSSMARCSLFGDDFISTFDETMYSFAGDCSYLLAGDCQKHSFSLIGDFQNGKRVSLSVYLGEFFDIRLFVNGTVLQGDQRVSMPYASNGLYLETEAGYYKLSSEAYGFVARIDGSGNFQILLSDRHFNKTCGLCGNSNVFAEDDFRTQEGTLTSDPYDFANSWAMSSGEQRCKRASPPSSPCNASSEDVQEGLWEQCQLLKSASVFTRCHPLVDPEPFMALCEQTLCTCTQGPRCPCVALLEYARACAHQGMVLYGWTQHSPCRPLCPAGMEYKECVSPCTRTCQSLHVNEACQEQCVDGCSCPEGQLLDEGRCVESSECSCVHSGKRYPPGASLSRDCNTCICRNSLWICSNEECPGECLITGQSHFKSFDDRYFTFSGVCHYLLARDCQDRSFSIVIETVQCADDPDAVCTRAVTVRLPSLHNSLVKLKHGGGIAIDGQDVQIPLLQGDLRIQHTVMASVRLSYGEDLQMDWDGRGRLLVKLSPVYAGKTCGLCGNFNGNKGDDFRTPAGLAEPLVEDFGNAWKLRGDCEDLRRQHSDPCSLNPXTAKFSEEACSLLTSPKFEACHHAVGPQPYLQNCRYDVCSCSDGRDCLCAAVANYAAACARKGVHVAWREPGFCALSCPQGQVYLQCGTPCNMTCRSLSHPDEECTEVCLEGCFCPPGLYLDERGDCVPKAQCPCYYDGEIFQPEDIVSDHHTMCYCEDGYMHCTSSGAPGSLLLQHTALSSPLSHRSKRSLYCRPPMVKLVCPADNPRAEGLECAKTCQNYDLECMSTGCVSGCLCPEGMVRHENRCVALERCPCFHQGKDYAPGEMVKIGCNTCVCRDRKWNCTDHVCDATCSTIGVAHYLTFDGLKYMFPGECQYVLAQDYCGSNPGTFRILVGNEGCGFPSVKCKKRVTILVDEGEIELFDGEVNVKRPMKDETHFEVVESGRYIILLLGKALSVVWDHHLGISVVLKQTFQERVCGLCGNFDGIQNNDFTGSNLQVEDDPVDFGNSWKVSPQCADTRKVPLNSFPATCHNNIMKQSMVDSSCRILTSDVFQGCNKLVDPEPFLDVCVYETCSCESIGDCACFCDTIAAYAHVCAQHGQVVTWRTATLCPQSCEERNLREDGYECEWRYNSCAPACPTTCQHPEPLACPVQCVEGCHAHCPPGKILDELLQTCVDAEDCPVCEVSGRRLASGKKITLNPSDPEHCQICHCDGVNLTCEACREANGLEVPPTEGPVSPTTPFVEDTPEPPLHDYYCSKLLDLVFLLDGSSKLSEAEFEVLKVFVVSMMERLHISQKWIRVALVEYHEGSHAYIQLRDRKRPSELRRLASQVKYAGSAVASTSEVLKYTLFQIFGKVDRPEASRIALLLTASQEPQKLGRNLLRYVQGLKMKKVVVVPVAIGPHANLKQIRLIERQAPENKAFVLSSVDELEQRRDEIVSYLCDLAPEAPAPTQPPPMAKVTVGPEHVGVSTQGPKRNSMALDVVFVLEGSDQIGEANFNRSKEFMEEVIRRMDVGQDSIHVTVLQYSYTVTVESTFRETQSKGDVLQRVREIRFQGGNSTNTGLALQYVSEHSFLASQGDREQAPNLVYMVTGNPASDQIKRMPGDIHVVPIGVGPHANLQELERIGWPNAPILIRDFDTLPREAPDLVLQRCCSEEGLQIPTLSPAPDCSQPLDVVLLLDGSSGFPASYFDEMKSFAKAFISKANIGPQLMQVSVLQYGSITTIDVPWNVAQEKTHLLSLVDYMQQEGGPRQIGSALGFAVQYITSEIHGARPGASKAVVILVMGVSTDSVAAAAATARSNRVTVFPIGIGDQYDTAQLRTLAGPDASSNVVKLQRIEDLPTLGSSFLHKLCSGFVRVCVDEDGNEKRPGDVWTLPDQCHTVTCLPDGQTLLNSHRVNCDRGPRPSCPNSQSPVRVEETCGCRWTCPCVCMGSSTRHIVTFDGQNFKLTGSCSYVLFQNKEQDLEVILHNSACSPGARQACMKSIEVKHNGLSVELHSDMEVGVNGRLVSVPYTGGDMEVNIYGAIMYEIRFNRLGHIFTFTPQNNEFQLQLSPKTFASKMYGLCGICDENGANDFMLRDGTVTTDWKRLIQEWTVQQPGRTCQPVPEDECPVSSTSHCQVLLSTLFAECHKVLAPATFYAICQQDSCHPEQVCEVIASYAHLCRTNGVCVNWRTTDFCAMTCPPSLVYSHCELGCPRSCDGNSSSCGDHPSEGCFCPSHQVMLEGSCVPEEACTQCVSEDGVRHQFLETWVPDHQPCQICTCLSGRKVNCTEHPCPTARVPTCGPCEVARLRQNADQCCPVYECVCDVVSCDLPPTPHCEGGLQLTLTNPGECRPNFTCACRKEECRRESPPSCPPHRTPTLRETQCCDEYECACNCVNSTVSCPLGYLSSVITNDCGCTTITCLPDKVCVHRGTVYPIGQFWEEGCDVCTCTDMEDAVMGLRVAQCSQKPCEESCQLGFSLVLHEGECCGRCLPSACEVVVGSPRGDSQSYWKDVGSHWPSPGNPCLINECVRVKEEVFVQQRNVSCPQLDVPACPTGFQLSCETSECCPTCRCEPVEACILNGTIIGPGTSLMIDVCTTCHCTAQAGIISGFKLECRKTTCEACPLGYKEEKIQGECCWRCLPVACTIQLRGGQVMTLKRDEMFQDGCDSHFCKVNERGEYIWEKRVTGCAPFDEHRCLAQGGKILKIPGTCCDTCEEPDCKDITARLQYVKVGNCKSEEQVDIHYCQGKCASKALYSIETEDVQDQCSCCSPTQTEPMQVPLRCTNGSIVYHEVLNAMQCRCSPRKCSK

SEQ ID NO: 132 - protein, 2822 aa, Cricetulus griseus
  misc_feature (1282)..(1288): Xaa can be any naturally occurring amino acid
MARCSLFGDDFINTFDETMYSFAGGCSYLLAGDCQKHSFSIIGLQIQVLYFLFCFRYLLHSLLPLDINGLDIVPLTGNYQDGKRVSLSVYLGEFFDIHLFANGTVMQGYQSIDMPYASKGLHLETEAGYYKLSSEAYGFVARIDGDGNFQVLMSDRHFNKTCGLCGDFNIFAEDDFRTQEGALTSDPYDFANSWALSGEEQRCKRASPPSSHCNSSSGDMHKAMWEQCQLLKSASVFARCHPLVDPEPFVALCEKTLCTCTTGPECSCPALLEYARTCAQEGMVLYGWTDHSACHPACPAGMEYKECVSPCTRTCQSLPISEVCQQQCVDGCGCPEGELLDEDRCVQSSECSCVHAGKRYPPGTSLSQDCNTCICRNSLWICSNEECPGECLVTGQSHFKSFDNRYFTFSGICQYLLARDCQDHSFSIVIETVQCADDPDAVCTRSVTLRLSALHNSLVKLKHGGGVAIDGQDVQIPFLQGGLHIQHTVMASVRLSYEEDLQMDWDGRGRLLVKLSPVYSGKTCGLCGNYNGNKGDDFLTPAGLVEPLVVDFGNAWKLQGDCPDLHMQHSDPCSLNPRLTRFAEEACALLTSSKFEACHHAISPLPYLQNCRYDVCSCSDGRDCLCSAVANYAAACARKGVHIGWREPDFCALGCPQGQVYLQCGNSCNLTCRSLSYPDEECNEVCLEGCFCPPGLYQDERGNCVPKAQCPCYYDGELFQPADIFSDHHTMCYCEDGFMHCTTSVGPGSLLPDIVLSSPLSHRSKRSLSCRPPMVKLVCPADNPRAQGLECAKTCQNYDLECMSLGCVSGCLCPPGMVRHENKCVALERCPCFHQGQEYAPGDKVKIDCNTCVCRDRRWNCTDHVCDATCSAIGMANYITFDGLKYLFPGECQYVLVQDYCGDNPGTFRILVGNEGCSYPSVMCKKRVTILVEGGEIELSDGEVNVKKPLKDESHFEVVESGRYVLLLLGPALSVVWDHHLSVSVVLKRTYQEQVCGLCGNFDGIQNNDFTSSSLQVEEDPVDFGNSWKVSSQCANTRKLSLDVPPATCHNNIMKQTMVDSSCRILTSDIFQGCNRLVDPEPYLDICIYDTCSCESIGDCACFCDTIAAYAHVCAQHGQVVPWRTPTLCPQSCEARNVQENGYECEWRYNSCAPACPVTCQHPEPLACPVQCVEGCHAHCPPGRILDELLQTCVDPQDCPVCEVAGRRLAPGKRITLSPDDPAHCQNCHCDGVNLTCEACGEPGGLVVPPTDGPVSSTTPYVEETPEPPLHSFYCSKLLDLXXXXXXXLLDGSSRLSEAEFEVLKAFVVGTMERLHISQKRIRVAVVEYHDGSHAYIDLKDRKRPSELRRIASQVRYAGSQVASTSEVLKYTLFQIFGRIDRPEASRIVLLLTASQEPPRLARNLVRYVQGLKQKKIIVIPVGIGPHASLRQVRLIEKQAPENKAFLLSGVDELEQRRDEIISYLCDLAPEPRAPTKRPQVAQITTSPGTLGISSPGPKRKSMVLDVVFVLEGSDKVGEANFNKSKEFLEEVIRRMDVSQDGTHISVLQYSYTATVEYTFNEAQSKEDVLRHVREIRYHGGNRTNTGQALQYLSEYSFSPSQGDREQAPNLVYLVTGNPASDEIKRLPGDIQVVPIGVGPRANTQELERIGWPNAPIFIRDFETLPREAPDLVLQRCCSREGLQLPTLSPTPDCSQLLDVVLLLDGSSSLPESYFDMMKSFAKAFISKANIGPHLTQVSVLQYGSINTIDVPWNVAQEKAHLLSLVDLMQREGGPSKIGDALAFAVRYVTSQIHGARPGASKAVVILILGTSLDSVDTAADAARSNRVAVFPIGVGDRYDEAQLRILAGPGASSNVVKLQQVEDLPTIVTPGNSFFHRLCSGFSGVCVDEDGNEKRPGEVWTLPDQCHTVTCLPNGQTLLQSHRVNCDHGPRPSCSNSQSPVRVEENCGCRWTCPCVCTGSSTRHIITFDGQNFKLTGNCSYVLFHNKEQDLEVILHNGACSPGARQACMKSIEIKHGGLSVELHSDMEMSVNGRLVPAPYVGGDMEVSVYGAIMYEVRFNHLGHILTFTPQNNEFQLQLSPKTFASKMYGLCGICDENGANDFMLRDGTVTADWKRLIQEWTVQQPGYPCQPVPEEQCPVSDSSHCQVLLSALFAECHKVLAPATFHAICQQDSCHQERVCEVIASYAHLCRTNGVCVDWRTTDFCAMSCPASLVYNHCEHGCPRHCDGNTTSSCGDHPSEGCFCPQHQVMLEGSCVPEEACTQCIGEDGVRHQFLETWVPDHQPCQICVCLSGRKANCTAQPCPTARAPTCGPCEVARLKESANRCCPEYECECDLANCNLPPVPPCEGGFQPTLTNPGECRPTFTCACRKEECKRVSPPSCPPHRTPTLRKTQCCDEYECACSCVNSTLSCPLGYLASTTTNDCGCTTTTCLPDKVCVHRGTIYPVGQFWEEGCDTCTCTDMEDTVMGLRVAQCSQKPCEDSCQPGFSYVFHEGECCGRCLPSACKVMVGSPRGDSFSSWKNVGSRWAAPENPCLINECVRVEEAVFVQQRNISCPQLAVPTCPTGFQLSCETSECCPSCRCEPMEACLLNGTIIGPGKSVMVDLCTTCRCIVQTGATSRFKLECRKTTCAACPMGYREEKNEGECCGRCLPTACTIQLRGGQIMTLKRDETLQDGCDSHFCKVNERGEYIWEKRVTGCPPFDERRCLAEGGKIVKIPGTCCDTCEEPDCKDIVAKLQYVKVGDCKSQEEVDIHYCQGKCASKAVYSIDIEDVQQHCSCCGPSRTEPMRVPLHCTNGSVVYHEVINAMQCRCSPQKCSK

SEQ ID NO: 133 - protein, 2817 aa, Cricetulus griseus
MARCSLFGDDFINTFDETMYSFAGGCSYLLAGDCQKHSFSIIGLQTQVLYFLFCFVYLPHSLLPLDINGLDIVPLTGNYQDGKRVSLSVYLGEFFDIHLFANGTVMQGYQSINMPYASKGLHLETEAGYYKLSSEAYGFVARIDGDGNFQVLMSDRHFNKTCGLCGDFNIFAEDDFRTQEGALTSDPYDFANSWALSGEEQRCKRASPPSSHCNSSSGDMQKAMWEQCQLLKSASVFARCHPLVDPEPFVALCEKTLCTCTTGPECSCPALLEYARTCAQEGMVLYGWTDHSACHPACPAGMEYKECVSPCTRTCQSLPISEVCQQQCVDGCGCPEGELLDEDRCVQSSECSCVHAGKRYPPGTSLSQDCNTCICRNSLWICSNEECPGECLVTGQSHFKSFDNRYFTFSGICQYLLARDCQDHSFSIVIETVQCADDPDAVCTRSVTLRLSALHNSLVKLKHGGGVAIDGQDVQIPFLQGDLRIQHTVMASVRLSYEEDLQMDWDGRGRLLVKLSPVYSGKTCGLCGNYNGNKGDDFLTPAGLVEPLVVDFGNAWKLQGDCPDLHMQHSDPCSLNPRLTRFAEEACALLTSSKFEACHHAISPLPYLQNCRYDVCSCSDGRDCLCSAVANYAAACARKGVHIGWREPDFCALGCPQGQVYLQCGNSCNLTCRSLSYPDEECNEVCLEGCFCPPGLYQDERGNCVPKAQCPCYYDGELFQPADIFSDHHTMCYCEDGFMHCTTSVGPGSLLPDIVLSSPLSHRSKRSLSCRPPMVKLVCPADNPRAQGLECAKTCQNYDLECMSLGCVSGCLCPPGMVRHENKCVALERCPCFHQGQEYAPGDKVKIDCNTCVCRDRRWNCTDHVCDATCSAIGMANYITFDGLKYLFPGECQYVLVQDYCGDNPGTFRILVGNEGCSYPSVTCKKRVTILVEGGEIELSDGEVNVKKPLKDESHFEVVESGRYVLLLLGPALSVVWDHHLSVSVVLKRTYQEQVCGLCGNFDGIQNNDFTSSSLQVEEDPVDFGNSWKVSSQCANTRKLSLDVPPATCHNNIMKQTMVDSSCRILTSDIFQGCNRLVDPEPYLDICIYDTCSCESIGDCACFCDTIAAYAHVCAQHGQVVPWRTPTLCPQSCEARNVQENGYECEWRYNSCAPACPVTCQHPEPLACPVQCVEGCHAHCPPGRILDELLQTCVDPQDCPVCEVAGRRLAPGKRITLSPDDPTHCQNCHCDGVNLTCEACGEPGGLVVPPTDGPVSSTTPYVEETPEPPLHSFYCSKLLDLVFLLDGSSRLSEAEFEVLKAFVVGTMERLHISQKRIRVAVVEYHDGSHAYIDLKDRKRPSELRRIASQVRYAGSQVASTSEVLKYTLFQIFGRIDRPEASRIVLLLTASQEPPRLARNLVRYVQGLKQKKITVIPVGIGPHASLRQVRLIEKQAPENKAFLLSGVDELEQRRDEIISYLCDLAPEPRAPTKRPQVAQITTSPGTLGISSPGPKRKSMVLDVVFVLEGSDKVGEANFNKSKEFLEEVIRRMDVSQDGTHISVLQYSYTATVEYTFNEAQSKEDVLRHVREIRYHGGNRTNTGQALQYLSEYSFSPSQGDREQAPNLVYLVTGNPASDEIKRLPGDIQVVPIGVGPRANTQELERIGWPNAPIFIRDFETLPREAPDLVLQRCCSREGLQLPTLSPTPDCSQPLDVVLLLDGSSSLPESYFDMMKSFAKAFISKANIGPHLTQVSVLQYGSINTIDVPWNVAQEKAHLLSLVDLMQREGGPSKIGDALAFAVRYVTSQIHGARPGASKAVVILILGTSLDSVDTAADAARSNRVAVFPIGVGDRYDEAQLRILAGPGASSNVVKLQQVEDLPTIVTPGNSFFHRLCSGFSGVCVDEDGNEKRPGEVWTLPDQCHTVTCLPNGQTLLQSHRVNCDHGPRPSCSNSQSPVRVEETCGCRWTCPCVCTGSSTRHIITFDGQNFKLTGNCSYVLFHNKEQDLEVILHNGACSPGARQACMKSIEIKHGGLSVELHSDMEMSVNGRLVPAPYVGGDMEVSVYGAIMYEVRFNHLGHILTFTPQNNEFQLQLSPKTFASKMYGLCGICDENGANDFMLRDGTVTTDWKRLIQEWTVQQPGYPCQPVPEEQCPVSDSSHCQVLLSTLFAECHKVLAPATFHAICQQDSCHQERVCEVIASYAHLCRTNGVCVDWRTTDFCAMSCPASLVYNHCEHGCPRHCDGNTTSSCGDHPSEGCFCPQHQVMLEGSCVPEEACTQCIGEDGVRHQFLETWVPDHQPCQICVCLSGRKANCTAQPCPTARAPTCGPCEVARLKESANRCCPEYACECDLANCNLPPVPPCEGGFQPTLTNPGECRPTFTCACRKEECKRVSPPSCPPHRTPTLRKTQCCDEYECACSCVNSTLSCPLGYLASTTTNDCGCTTTTCLPDKVCVHRGTIYPVGQFWEEGCDTCTCTDMEDTVMGLRVAQCSQKPCEDSCQPGFSYVFREGECCGRCLPSACKVMVGSPRGDSFSSWKNVGSRWAAPENPCLINECVRVEEAVFVQQRNISCPQLAVPTCPTGFQLSCETSECCPSCRCEPMEACLLNGTIIGPGKSVMVDLCTTCRCIVQTGATSRFKLECRKTTCAACPMGYREEKNEGECCGRCLPTACTIQLRGGQIMTLKRDETLQDGCDSHFCKVNERGEYIWEKRVTGCPPFDERRCLAEGGKIVKIPGTCCDTCEEPDCKDIVAKLQYVKVGDCKSQEEVDIHYCQGKCASKAVYSIDIEDVQQHCSCCGPSRTEPMRVPLHCTNGSVVYHEVINAMQCRCSPQKCSK

SEQ ID NO: 134 - protein, 2813 aa, Pan troglodytes; identical to SEQ ID NO: 76

SEQ ID NO: 135 - protein, 2813 aa, Cebus capucinus imitator
MIPARFARVLLALALTLPGILCAEGTRGRSSMARCSLFGSDFINTFDGSMYSFAGYCSYLLAGDCQKHSFSIIGDFQNGKRLSLSVYLGEFFDIHLFVNGTVTQGDQRVSMPYASKGLYLETEAGYYKLSGEAYGFVARIDGSGNFQVLLSDRYFNKTCGLCGNFNIFAEDDFMTQEGTLTSDPYDFANSWALSSGEQWCERASPPSGSCNISSGEMQKGLWEQCQLLKSTSVFARCHPLVDPEPFVALCEKTLCECTEGLQCVCPAFLEYARTCAQEGMVLYGWTSHSACSPVCPAGMQYKQCVSPCTGTCQSLHINEVCQEQCVDGCSCPEGQLLDEGVCVESTECPCVHSGKRYPPGTSLSQDCNTCICRNSQWICSNEECPGECLVTGQSHFKSFDNRYFTFSGICQYLLARDCQDHSFSIVIETVQCADDPDAVCTRFVTIRLPGLHNSLVKLKHGGGVAMDGQDVQLPLLKGDLRIQHTVTTSVHVSYGEDLQMDWDGRGRLLVKLSPVYSGKTCGLCGNYNGNQGDDFLTPSGLAEPRVEDFGNAWKLHGDCQDLQKQHSDPCALNPRMTRFSEEACAVLASPAFEACHRAVSPLPYLRNCRYDVCSCSDGRECLCGALASYAAACAGRGVRIAWREPGRCELNCPKGQVYLQCGTPCNLTCHSLSYPDEECSEDCLEGCFCPPGLYMDERGDCVPKAQCPCYYDGEIFQPEDVFSDHHTMCYCEDGFMHCTMSEVPGSLLPDAVLSSPLTHRSKRSLSCRPPMVKLVCPADNPRAEGLECAKTCQNYDLECMSTGCVSGCLCPPGMVRHENRCVALERCPCFHQGKEYAPGETVKIDCNTCVCRDRKWNCTGHVCDATCSTIGMAHYLTFDGLKYMFPGECQYVLVQDYCGSNPGTFRILVGNEGCSHPSVKCKKRVTILVEGGEIELFDGEVNVKRPMKDETHFEVVESGRYIILLLGKALSVVWDRHLSISVVLKQTYQEQVCGLCGNFDGVQNNDLTSSNLQVEVDSVDFGNSWKVSSQCADTRKVPLDSSPATCRNNIMKQTMVDSSCRILTSDVFQDCNKLVDPEPYLDACIYDTCSCESIGDCTCFCDTLAAYAHMCAQHGKVVTWRTTTLCPQSCEERNLRESGYECEWRYNSCAPACRVTCQHPEPLACPVQCVEGCHAHCPPGKILDELLQTCINPEDCPVCEVAGRRLASGKKVTLNPSDPEYCQICHCDGVNLTCEACQEPGGLVMPPTDAPVSPTTPYMEDVSEAPLHDFYCSKLLDLVFLLDGSSRLTEAEFEVLKAFVVDMMERLRISQKWVRVAVVEYHDGSHAYIGLKDRKRPSELRRIASQVKYVGSQVASTSEVLKYTLFQIFGKIDRPEASRIILLLMASQEPQRMSRNFARYVQGLKNKKVTVIPVGIGPHANLKQIRLIEKQGPENKAFVLSGVDELEQQRDEIVSYLCDLAPEAHPPTVPPHMAQVTVGPGLLGVSPSGHKRKSMVLDVAFVLEGSDKIGEADFNRTKEFMEEVIQRMDVGQDGIHVTVLQYSYMVTVEYPFSEAQSKGDILQRVREIRYQGGNRTNTGLALQHLSEHSFLVSQGDREQAPNLVYMVTGNPASDEIKRLPGDIQVVPIGVGPHANVQELERIGWPNAPILIQDFETLPREAPDLVLQRCCSGDGLQIPTLSPAPDCSQPLDVVLLLDGSSSSPASYFDEMKSFAKAFISKAKLGPHLTRVSVLQYGSITTIDVPWNVATEKAQLLSLVDVMQREGGPSQIGSGLDFAVRYLTSEVHGARPGASKAVVLLVTDVSVDSVGAAADAARANRVTVFPIGIGDRYEAAQLRILAGPAADSNMVSLQRIEDLPTVVTLGNSFLHKLCSGFVRICMDEDGNEKRPGDVWTLPDQCHTVTCQPDGQTLLKSHRVNCDRGPRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVAVNGRLVSVPYVGGNMEVSIYGAIMHEVRFNHLGHIFTFTPQNNEFQLQLSPKTFASKTYGLCGICDENGANDFMLRDGTVTTDWKTLVREWTMQQSGQTCQPVLEEQCPVSDSSQCQVLLSALFAECHKVLAPATFYAICQQDSCHREQVCEVIASYAHLCRTSGVCVDWRTPDFCAMSCPSSLVYNHCERGCPRHCDGNVSACGDHPSEGCFCPPNQVMLEGSCVPKEACSQCIGEDGVRHQFLEAWVPDHQPCQICTCLSGRKVNCTTQPCPTAKAPTCGLCEVARLRQNADQCCPEFECVCDPASCDLPTVPHCEGGLQPILTNPGECRPKFTCACRKEECERASPPSCPPHRSLTLRKTQCCDEYECACNCVNATVSCPLGYLASTATNDCGCTTTTCLPDKVCVHRGTVYPVGQFWEEGCDVCTCTDMEDAVMGLRVAQCSQKPCEDSCHSGFTYVLHEGECCGRCLPSACEVVTGSRRGDSQSSWKSVGSRWASLENPCLINECVRVKEEVFVQQRNVSCPQLEVPFCPPGFQLSCKTSECCPRCGCEPVEACVLNGTIIGPGKSVMVDVCTSCHCIVEVGATSGFRLECRKTTCKPCPLGYKEEENPRECCGKCLPTACTIQLRGGQIMTLKRDETLQDGCDSHSCKVNEMGEYIWEKRVTSCPPFDEHECLAEGGKIMKTPGTCCDRCEVPECKDITARLQYVKVGSCKSEVQVDIHYCQGKCASKAMYSIDIEDVQDQCSCCSPTRTEPMRVPLRCTNGSVVYHEVLNAMQCKCSPRKCSK

SEQ ID NO: 136 - protein, 2813 aa, Rhinopithecus bieti
MIPARFAGVLLAVALVLPGTLCAEGTRGRSSMARCSLFGSDFINTFDGSMYSFAGYCSYLLAGDCQKRSFSIIGDFQSGKRVSLSVYLGEFFDIHLFVNGTVTQGDKRVSMPYASKGLYLETEAGYYKLSGEVYGFVARIDGSGNFQVLLSDRYFNKTCGLCGNFNIFAEDDFMTQEGTVTSDPYDFANSWALSSGEQWCERASPPSSSCNISSGEMQKGLWEQCQLLKSTSVFARCHPLVDPEPFVALCEKTSCECAGGLECTCPAFLEYARTCAQEGMVLYGWTDHSACSPVCPAGMEYKQCVSPCARTCQSLHVNEVCQERCMDGCSCPEGQLLDEGLCVESTECPCMHSGKRYPPSASLSRDCNTCICRNSQWICSNEECPGECLVTGQSHFKSFDNRYFTFSGICQYLLARDCQDHSFSIVIETVQCADDPDAVCTRSVTVRLPGLHHSLVKLKHGGGVAMDGQDVQLPLLKGDLRIQHSVMASVRLSYGEDLQMDWDGRGRLLVKVSPVYAGKTCGLCGNYNGNQGDDFLTPSGLAEPRVEDFGNAWKLHGDCQDLQKQHSDPCALNPRMTRFSEEACAVLTSPTFEACHRAVSPLPYLRNCRYDVCSCSDGRECLCGALASYAAACAGKGVRVAWREPGRCELKCPKGQVYLQCGNPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGSNPGTFRILVGNEGCSHPSVKCKKHVTILVEGGEIELFDGEVNVKRPMKDETHFEVVESGRYIILLLGKALSVVWDHHLSISVVLKQTYQEKVCGLCGNFDGVQNNDLTSSNLQVEEDPVEFGNSWKVSSQCADTRKVPLDSSPATCHNNLMKQTMVDSSCRILTSDVFQDCNKLVDPEPFLDVCIYDTCSCESTGDCACFCDTVAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNFTCEACEEPRGLVVPPTDAPVSPTTPYVEDISEAPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIVLLLMASQEPQRMSRNFVRYVQGLKKKKVIIIPVGIGPHANLKQIRLVEKQSPENKAFVLSGVDELEQQRDEIVSYLCDLAPEAPPPTLAPDMAQVTVGPGLLGVSTLGLKRNSMVLDVAFVLEGSDNIGEADFNRSKEFMEEVIQRMDVGQDGIHVTVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPPPDCSQPLDVILLLDGSSSFPASYFDEMKSFAKAFISKANIGPHLTQVSVLQYGSITNIDVPWNVALEKAHLLSLVDVMQREGGPSQIGDALGFAVRYLTSEMHGARPGASKAVVILVMDVSVDSVDAAADAARSNRVTVFPIGIGDRYDAAQLRILAGPAGDSNVVKLQRIEDLPTMVTLGNSFLHKLCSGFVRICMDEDGNEKRPGDVWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHSALSVELHSDMEVTVNGRLVSVPYVGGNMEVNVYGAIMHEIRFNHLGHIFTFTPQNNEFQLQLSPKTFASKTYGLCGICDENGANDFMLRDGTVTTDWKALVQEWTVQRPGQTCWPILEEQCLVPNSSQCQVLLSALFAECHKVLAPATFYAICQQDSCHREQVCEVIASYAHLCRTNGICVDWRTPDFCAMSCPPSLVYNPCERGCPRHCDGNVSSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGLHPTLTNPGECRPNFTCACRKEECKRVSPPSCPPHRLPTLRKTQCCDEYECACNCVNSTVSCPLGYLASTATNDCGCTTTTCLPDKVCVHRSTIYPVGQFWEEGCDVCTCTDMEDAVMGLRVVQCSQKPCEDSCRSGFTYVLHEGECCGRCLPSACEVVTGSPRGDSQSSWKSVGSHWASPENPCLINECVRVKEEVFVQQRNVSCPQLEVPVCPSGFQLSCKTSACCPSCRCEPVEACMLNGTMIGPGKSVMIDACTTCRCTVQVGIISGFKLECRKTTCNPCPLGYKEENNTGECCGRCLPTACTIRLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 137 - protein, 2781 aa, Papio anubis
  misc_feature (1017)..(1017): Xaa can be any naturally occurring amino acid
  misc_feature (1563)..(1563): Xaa can be any naturally occurring amino acid
MARCSLFGSDFINTFDGSMYSFAGYCSYLLAGDCQKRSFSIIGDFQSGKRASLSVYLGEFFDIRLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAEGLECTCPAFLEYARTCAHEGMVLYGWTDHSACSPVCPAGMEYKQCVSPCARTCQSLHINEVCQERCMDGCSCPEGQLLDEGLCVESTECPCMHSGKRYPPSASLSRDCNTCICRNSQWICSNEECPGECLVTGQSHFKSFDNRYFTFSGICQYLLARDCQDHSFSIVIETVQCADDPDAVCTRSVTIRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAISPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGGDPGTFRILVGNEGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPADFGNSWKVSSQCADTRKVPLDSSPATCHXNLMKQTMVDSSCRVLTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACKEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLIEKQSPDNKAFVLSGVDELEQQRDEIVSYLCDLAPEAPPPTLPPDMAQVTVGPGLLGVSTLGPKRNSMVLDVAFVLEGSDKIGEADFNRSKEFMEEVIQRMDVGQDGIHVAVLQYSYTVAVEYPFSEAQSKGDILQRVREIRYQGGNRTNTGLALQYLSEHSFLVSXGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVALEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHGALSVELHSDMEVTVNGRLVSVPYVGGNMEVNVYGAIMHEIRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCWTNGVCVDWRTPDFCAMSCPPSLVYNPCERGCPRHCDGNVSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGFQPTLTNPGECRPNFTCACRKEECKRVSPPSCPPHRLPALRKTQCCDEYECACNCVNSTVSCPLGYLASTATNDCGCTTTTCLPDKVCVHRSTIYPMGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPLGFQLSCKTSACCPSCHCEPVEACMLNGTMIGPGKSVMIDACTTCRCIVQVGIISGFKLECRKTICNPCPLGYKEENNTGECCGRCLPTTCTIRLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 138 - protein, 2816 aa, Mus pahari
MGKMNPFRYEICLLVLALTWPGTLCTEKPSDRPLTARCSLFGDDFINTFDETMYSFAGDCSYFLAGDCQKHSFSILGNFQDGKRMSLSVYLGEFFDIHLFANGTVMQGDQSISMPYASQGLYLELEAGYYKLSSEAFGFAARIDGNANFQVLLSDRHFNKTCGLCGDFNIFAEDDFRTQEGTLTSDPYDFANSWALSSEEERCKRASPPSRNCESSSGDMHQAMWEQCQLLKTASVFARCHPLVDPEPFVALCEKTLCTCVTGPECACPVLLEYARTCAQEGMVLYGWTDHGACRPACPAGMEYKECVSPCPRTCQSLPFNEVCQQQCVDGCSCPEGELLDEDRCVQSSDCPCVHAGKRYPPGTSLSQDCNTCICRNSLWICSNEDCPGECLVTGQSHFKSFDDRYFTFSGICQYLLARDCEDHSFSIIIETMQCADDPDAVCTRWVSVRLSALHNSLVKLKHGGGVAIDGQDVQIPFLQGDLRIQHTVMASVRLSYGEDLQMDWDGRGRLLVKLSPVYSGKTCGLCGNYNGNKGDDFLTPAGLVEPLVVDFGNAWKLQGDCPDLHRQHSDPCSLNPRLTRFAEEACALLTSSKFEACHRAVSPLPYLQNCRYDVCACSDGRDCLCNAVANYAAACARKGVHIGWREPGFCALGCPLGQVYLQCGNSCNLTCRSLSLPDEECSEVCLEGCFCPPGLYQDERGDCVPKAQCPCYYDGELFQPADIFSDHHTMCYCEDGFMHCTTSGAPGSLLPDTVLSSPLSHRSKRSLSCRPPMVKLVCPADNPRAQGLECAKTCQNYDLECMSLGCVSGCLCPPGMVRHENKCVALERCPCFHQGEEYAPGDTVTIGCNTCVCRERKWNCTNHVCDATCSAIGMAHYLTFDGLKYLFPGECQYVLVQDYCGSNPGTFQILVGNEGCSYPSVTCRKRVTILVEGGEIELFDGEVNVKRPLRDESHFEVVESGRYVILLLTQALSVVWDHHLSISVVLQHTYQEQVCGLCGNFDGIQNNDFTSSSLQVEEDPINFGNSWKVSSQCADTRKLSLDVSPATCHNNIMKQTMVDSACRILTSNTFQSCNRLVDPEPYLDICIYDTCSCESIGDCACFCDTIAAYAHVCAQHGQVIAWRTSTLCPQSCEERNVRENGYECEWRYNSCAPACPVTCQHPEPLACPVQCVEGCHAHCPPGKILDELLQTCVDPQDCPVCEVAGRRLAPGKKITLSPDDPTHCQNCHCDGVNLTCEACQEPGGLVVPPTDAPVSSTTPYVEDTPEPPLHNFYCSKLLDLVFLLDGSSMLSEAEFEVLKAFVVGMMERLHISQKRIRVAVVEYHDGSRAYLELKARKRPSELRRITSQIKYTGSQVASTSEVLKYTLFQIFGKIDRPEASHITLLLTASQEPPRMARNLVRYVQGLKKKKVIVIPVGIGPHASLKQIRLIEKQAPENKAFLLSGVDELEQRRDEIISYLCDLAPEAPAPTQPPQVAHVTMSPGVSGISSPGPKRKSMVLDVVFVLEGSDEVGEANFNKSKEFVEEVIQRMDVSPDETRISVLQYSYTVTVEYTFNEAQSKEEVLRHVREIRYQGGNRTNTGQALQYLSEHSFSPIQGDRVQAPNLVYMVTGNPASDEIKRLPGDIQVVPIGVGPHANMQELERISRPIAPIFIRDFETLPREAPDLVLQTCCSKEGLQLPTLPPLPDCSQPLDVVLLLDGSSSLPESSFDKMKSFAKAFISKANIGPHLTQVSVIQYGSINTIDVPWNVAQEKAHLQSLVDLMQQEGGPSQIGDALAFAVRYVTSQIHGARSGASKAVVIVVMDTSLDPVDTAADAARSNRVTVFPIGVGDRYDEAQLRMLAGPGASSNVVKLQRVEDLSTMAALGNSFFHKLCSGFSGVCVDEDGNEKKPGDVWTLPDQCHTVTCLANGQTLLQSHRVNCDHGPRPSCSNSQSPVRVEETCGCRWICPCVCTGSSTRHIVTFDGQNFKLTGSCSYIVFQNKEQDLEVLLHNGACSPGAKQACMKSIEVKHAGLSVELHSNMEMAVNGRLVLAPYVGGNMEVSIYGAIMYEVRFTHLGHILTYTPQNNEFQLQLSPKTFASKMYGLCGICDENGANDFTLRDGTVTTDWKRLIQEWTVQQPGYTCQSVPEEQCPISDSSHCQVLLSASFAECHKVIAPATFHTICQQDSCHQERVCEVIASYAHLCRTSGVCVDWRTTDFCAMSCPPSLVYNHCERGCPQRCDGNTSFCGDHPSEGCFCPQHQVLLEGSCVPEEACTQCVGEDGVRHQLLETWVPDHQPCQICMCLSGRKINCTAQPCPTARAPTCGPCEVARLKQSANLCCPEYECVCDLVNCNLPPVPPCEEGLQPTLTNPGECRPTFTCACRKEECKRAPPPSCPPHRTPTLRKTQCCDEYECACNCVNSTLSCPLGYLASATTNDCGCTTTTCLPDKVCVHRGTIYPVGQFWEEGCDTCTCTDMEDTVVGLRVVQCSQRPCEDSCQPGFSYVLHEGECCGRCLPSACKVVAGSLRGDSHSSWKSVGSRWAVPENPCLVNECVRVEDAVFVQQRNISCPQLAVPTCPTGFQLNCETSECCPSCHCEPVEACLLNGTIIGPGKSVMVDLCTTCRCIVQTGAMSRFKLECRKTTCEACPMGYREEKSQGECCGRCLPTACTIQLRGGRIMTLKQDETFQDGCDSHLCRVNERGEYIWEKRVTGCPPFDEHKCLAEGGKIVKIPGTCCDTCEEPDCKDITAKVQYIKVGDCKSQEEVDIHYCQGKCASKAVYSIDIEDVQEQCSCCRPSRTEPMRVPLHCTNGSVVYHEVINAMQCRCSPRNCSK

SEQ ID NO: 139 - protein, 2813 aa, Mesocricetus auratus
MNPAGFEIWLLALAFSWPGTLSTEKTGDRPSMARCSLFGDNFINTFDETMYSFAGGCSYLLAGDCQKRSFSIIVNYQDGKRVSLSVYLGEFFDIHLFANGTVIQGDQSITMPYAAKGLYLETEAGYYKLSSEAYGFVARIDGDGNFQVLMSDRHFNKTCGLCGDFNIFAEDDFRTQEGALTSDPYDFANSWALSGEEQRCKRASPPSGHCNSSSGDMQKAMWEQCQLLKSASVFARCHPLVDPEPFVALCEKTLCTCTTGPECACPALLEYARACAQEGMVLYGWTDHSACHPACPAGMEYKECVSPCTRTCQSQPISEVCQQRCVDGCRCPEGELLDEGRCVQSSECSCVHAGKRYPPGTSLSQDCNTCICRNSLWICSNEECPGECLVTGQSHFKSFDNRYFTFSGICQYLLARDCQDHSFSIVIETMQCADDPDAVCTRSVTVRLSALHNSLVKLKHGGGVAIDGQDVQIPFLQGDLRIQHTVMASVRLSYEEDLQMDWDGRGRLLVKLSPVYSGKTCGLCGNYNGNKGDDFLTPAGLVEPLVVDFGNSWKLQGDCPDLHRQHSDPCSLNPRLARFAEEACALLTSSKFEACHHAVSPLPYLQNCRYDVCSCSDGRDCLCSAVANYAAACAGKGVHIGWREPDFCALGCPQGQVYLQCGNSCNMTCRSLSYPEDECNEVCLEGCFCPPGLFQDERGDCVPKAQCPCYYDGELFQPADVFSDHHTMCYCEDGFMHCTTSGAPGSLLPDVVLSSPLSHRSKRSLSCRPPMVKLVCPADNPRAQGLECAKTCQNYDLECMSLGCVSGCLCPPGMVRHENKCVALERCPCFHQGQEYAPGDRVKIDCNTCVCRDRRWNCTNHVCDATCSAIGMAHYVTFDGLKYLFPGECQYVLVQDYCGDNPGTFRILVGNEGCSYPSVKCKKRVTILVEGGEIELSDGEVNVKKPLKDESHFEVVESGRFVLLLLGPGLSVVWDHHLSVSVVLKHTYQEQVCGLCGNFDGIQNNDFTSRSLQVEGDPVDFGNSWKVSSQCADTRKLSLDVSPATCHNNIMKQTMVDSSCRILTSDIFQGCNRLVDPEPYLDICIYDTCSCESIGDCACFCDTIAAYAHVCAQHGQVVSWRTPALCPQSCEARNVRESGYECEWRYNSCAPACPVTCQHPEPLACPVQCVEGCHAHCPPGRILDELLQTCVDSQDCPVCEMAGRRLASGKKITLSPDDPALCQNCHCDGVNLTCEACQEPGGLVVPPTDAPVSSTTPYVEDTPEPPLHSFYCSKLLDLVFLLDGSSRLSEAEFGVLKTFVVGMMERLHISQKRIRVAVVEYHDGSHAYIDLKDRKRPSELRRIASQVKYAGSQVASTSEVLKYTLFQIFSKIDRPEASRITLLLTASQEPPRLARNLVRYVQGLKKKKIIVIPVGIGPHVSLKQIRLIEKQAPENKAFLLSGVDELEQRRDEIIGYLCDLAPEPRAPTKPPQAARITTGPGTLGISSPGPKRKSMVLDVVFVLEGSDEVGEASFNKSKEFLEEVIQRMDVSQDGIHISVLQYSYMVTVEYTFREAQSKEDVLRHVREIRYHGGNRTNTGQALQYLSEHSFSPSQGDRDQAPNLVYMVTGNPASDEIRRLPGDIQVVPIGVGPHANTQELERIGWPNAPIFIRDFETLPREAPDLVLQRCCSGEGLQLPTLSSTPDCSQPLDVVLLLDGSSSLPESSFDAMKSFAKAFISKANIGPRLTQVSVLQYGRINTIDVPWDVAQEKAHLLSLVDLIQREGGPSQIGDALAFAVRYVTSQIHGARPGASKAVVILIMDTSLDSVDTAVDAARSNRVAVFPIGIGDRYDEAQLRILAGPGASSNVVKLQRVEDLPTIITLDNSFFHRLCSGFSGVCVDEDGVEKRPGDVWTLPDQCHTVTCLPNGQTLLQSHRVNCDHGPRPSCSNSQSPVRVEETCGCRWTCPCVCTGSSTRHIVTFDGQNFKLTGNCSYVFFQNKEQDLEVILHNGACGSGAMQACMKSIEIKHGGLSVELHSDMEMAVNGRLVPAPYVGGNMEVSIYGAIMYEVRFNHLGHILTFTPQNNEFQLQLSPKTFASKMYGLCGICDENGANDFMLRDGTVTTDWKRLIQEWTVQQPGYPCQPVPEEQCPVSDSSHCQVLLSALFAECHKVLAPTTFHAICQQDSCRQERVCEVIASYAHLCRTNGVCVDWRTTDFCAMSCPASLVYNHCERGCPRHCDGNTSSCADQPSEGCFCPQHQVMLEGSCVPEEACTECVGEDGVRHQFLETWVPDHQPCQICVCLSGRKANCTAQPCPTARAPTCGPCEVAHLKESASGCCPEYECVCDLANCTLPPMPPCEGGLQPTLTNPGECRPTFTCACRKEECKGVSPPSCPPHRTPALRKTQCCDEYECACSCANSTVSCPLGYLASTTTNDCGCTTTTCLPDKVCVHRGTIYPVGQFWEEGCDTCTCTDMEDTVMGLRVAQCSQKPCEDSCQPGFSYVFREGECCGRCLPSACKVEAGSPRGDYHSSWMSVGSQWAVPGNPCLINECVRVEEVVFVQQRNISCPQLAVPTCPTGFQLSCETFECCPRCRCEPMEACLLNGTIIGPGKSVMVDLCTACLCIVETGAISSFKLECRKTTCTACPTGYREEKSDGECCGRCLPTACTIQLRGGHITTLKRDETLQDGCDSHFCKVNERGEYIWEKRVTGCPPFNEHKCRTEGGRIVKIPGTCCDTCEEPDCKDIVAMLQYVKVGDCKSRDEVDIHYCQGKCASKAVYSIDVEDVQDQCSCCGPSRTESMRVPLHCTNGSVVYHEVINALQCRCSPRKCSH

SEQ ID NO: 140 - protein, 2703 aa, Aotus nancymaae
MPYASKGLYLETEAGYYKLSGEAYGFVARIDGSGNFQVLLSDRYFNKTCGLCGNFNIFAEDDFMTQEGTLTSDPYDFANSWALSSGEQWCERASPPSGSCNISSGEMQKGLWEQCQLLKSTSVFARCHPLVDPEPFVALCEKTLCECTEGLECMCPAFLEYARTCAQEGMVLYGWTNHGACSPACPAGMEYKQCVSPCTRTCQSLHINDVCQERCVDGCSCPEGQLLDEGLCVESTECPCVHSGKRYPAGTSLSRDCNTCICRNSQWICSNEECPGECLVTGQSHFKSFDNKYFTFSGICQYLLARDCQDHSFSIVIETVQCADDPDAVCTRFVTIRLPGLHNSLVKLKHGGGVAMDGQDVQLPLLKGDLRIQHTVTASVHVSYGEDLQMDWDGRGRLLVKLSPVYSGKTCGLCGNYNGNQGDDFLTPSGLAEPRVEDFGNSWKLHGDCQDLQKQHSDPCALNPRMTRFSEEACAVLTSPTFEACHRAVSPLPYLRNCRYDVCSCSDGRECLCGALASYAAACAGRGVRIAWREQGRCELNCPKGQVYLQCGTPCNLTCRSLSYPDEECSEDCLEGCFCPPGLYMDERGDCVPKAQCPCYYDGEIFQPEDIFSDHHTMCYCEDGFMHCTMSEVPGSLLPDAVLSSTLSHRSKRSLSCRPPMVKLVCPADNPRAEGLECAKTCQNYDLECMSTGCVSGCLCPPGMVRHENRCVALERCPCFHQGKEYAPGETVKIDCNTCVCRDRKWNCTGHVCDATCSTIGMAHYLTFDGLKYVFPGECQYVLVQDYCGSNPGTFRILVGNEGCSHPSVKCKKRVTILVEGGEIELFDGEVNVKRPMKDETHFEVVESGRYIILLLGKALSVVWDRHLSISVVLKQTYQEQVCGLCGNFDGIQNNDLTSSNLQVEEDSVDFGNSWKVSSQCADTRKVPLDSSPATCHNNIMKQTMVDSSCRILTSDIFQDCNKLVDPEPYLDACIYDTCSCESVGDCACFCDAIAAYAHMCAQHGKVVTWRTTTLCPQSCEERNLRESGYECEWRYNSCAPACRITCQHPEPLACPVQCVEGCHAHCPPGKILDELLQTCINPEDCPVCEVAGRRLASGRKVTLNPSDPEHCQICHCDGINLTCEACQELGGLVMPPTDAPVSPTTPYVEDVSEAPLHDFYCSKLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIILLLMASQEPQRMSRNFVQYVQGLKKKKVIVIPVGIGPHANLKQIRLIEKEAPENKAFVLSGVDELEQQRDEIVSYLCDLAPEAPPPTMPPNMAQVTMGPGVLGVSPLEHKRKSMVLDVAFVLEGSDKIGEADFNRTKEFMEEVIQRMDVGQDGIHVTVLQYSYMVTVEYPFSEAQSKGDILQRVREIRYQGGNRTNTGLALQHLSEHSFLVSQGDREQAPNLVYMVTGNPASDEIKRLPGDIQVVPIGVGPHANVQELERIGWPNAPILIQDFETLPREAPDLVLQRCCSGEGLQIPTLAPAPDCSQPLDVVLLLDGSSSFPASYFDEMKNFAKAFISKAKLGPHLTRVSVLQYGSITTIDVPWNVAMEKAHLLSLVDVMQREGGPSQIGNALDFAVRYLTSEVHGARPGASKAVVILVTDVSVDSVGAAADAARANRVTVFPIGIGDRYDAAQLRILAGPAANSNVVSLQRIEDLPTTVTLGNSFLHKLCSGFVRICMDEDGNEKRPGDVWTLPDQCHTVTCQPDGQTLLKSHRVNCDRGPRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVAVNGRLVSVPYVGGNMEVSVYGAIMHEIRFNHLGHIFTFTPQNNEFQLQLSPKTFASKTYGLCGICDENGANDFVLRDGTVTTDWKTLVQEWTVQQSGQTCQPILEEQCPVSDSSQCQVLLSALFAECHKVLAPATFYAICQQDSCHREQVCEVIASYAHLCRTSGVCVDWRTPDFCAMSCPSSLVYNHCERGCPQHCDGNVSSCGDHPSEGCFCPPNQVMLEGSCVPKEACTQCIGEDGVRHQFLEAWVPDHQPCQICTCLSGRKVNCTTQPCPTAKAPTCGLCEVARLRQNAEQCCPEYECVCDPVSCDLPVVPHCEGGLQPMLTNPGECRPNFTCACRKEECERVSPPSCPPHRFLTLRKTQCCDEYECACNCVNSTVSCPLGYLASTATNDCGCTTTTCLPDKVCVHRGTIYPVGQFWEEGCDVCTCTDMEDAVMGLRVAQCSQKPCEDSCRSGFTYVLHEGECCGRCLPSACEVVMGSRRGDSQSSWKSVGSHWASLENPCLINECVRVKEEVFVQQRNVSCPQLEVPFCPPGFQLSCKTSECCPRCRCEPVEACMLNGTIIGPGKSVMVDVCTACHCIVEAGATSGFQLECRKTTCKPCPPGYKEENNPGECCGRCLPTACTIRLRGGQIMTLKRDETLQDGCDSHSCKVNEIGEYIWEKRVASCPPFDEHKCLAEGGKIMKTPDTCCDRCEVPECKDITARLQYVKVGSCKSEVEVDIHYCQGKCASKAMYSIDIEDVQDQCSCCSPTRTEPMRVPLLCTNGSVVYHEVLNAMQCKCSPRKCSK

SEQ ID NO: 141 - protein, 2409 aa, Aotus nancymaae
MSSGICQYLLARDCQDHSFSIVIETVQCADDPDAVCTRFVTIRLPGLHNSLVKLKHGGGVAMDGQDVQLPLLKGDLRIQHTVTASVHVSYGEDLQMDWDGRGRLLVKLSPVYSGKTCGLCGNYNGNQGDDFLTPSGLAEPRVEDFGNSWKLHGDCQDLQKQHSDPCALNPRMTRFSEEACAVLTSPTFEACHRAVSPLPYLRNCRYDVCSCSDGRECLCGALASYAAACAGRGVRIAWREQGRCELNCPKGQVYLQCGTPCNLTCRSLSYPDEECSEDCLEGCFCPPGLYMDERGDCVPKAQCPCYYDGEIFQPEDIFSDHHTMCYCEDGFMHCTMSEVPGSLLPDAVLSSTLSHRSKRSLSCRPPMVKLVCPADNPRAEGLECAKTCQNYDLECMSTGCVSGCLCPPGMVRHENRCVALERCPCFHQGKEYAPGETVKIDCNTCVCRDRKWNCTGHVCDATCSTIGMAHYLTFDGLKYVFPGECQYVLVQDYCGSNPGTFRILVGNEGCSHPSVKCKKRVTILVEGGEIELFDGEVNVKRPMKDETHFEVVESGRYIILLLGKALSVVWDRHLSISVVLKQTYQEQVCGLCGNFDGIQNNDLTSSNLQVEEDSVDFGNSWKVSSQCADTRKVPLDSSPATCHNNIMKQTMVDSSCRILTSDIFQDCNKLVDPEPYLDACIYDTCSCESVGDCACFCDAIAAYAHMCAQHGKVVTWRTTTLCPQSCEERNLRESGYECEWRYNSCAPACRITCQHPEPLACPVQCVEGCHAHCPPGKILDELLQTCINPEDCPVCEVAGRRLASGRKVTLNPSDPEHCQICHCDGINLTCEACQELGGLVMPPTDAPVSPTTPYVEDVSEAPLHDFYCSKLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIILLLMASQEPQRMSRNFVQYVQGLKKKKVIVIPVGIGPHANLKQIRLIEKEAPENKAFVLSGVDELEQQRDEIVSYLCDLAPEAPPPTMPPNMAQVTMGPGVLGVSPLEHKRKSMVLDVAFVLEGSDKIGEADFNRTKEFMEEVIQRMDVGQDGIHVTVLQYSYMVTVEYPFSEAQSKGDILQRVREIRYQGGNRTNTGLALQHLSEHSFLVSQGDREQAPNLVYMVTGNPASDEIKRLPGDIQVVPIGVGPHANVQELERIGWPNAPILIQDFETLPREAPDLVLQRCCSGEGLQIPTLAPAPDCSQPLDVVLLLDGSSSFPASYFDEMKNFAKAFISKAKLGPHLTRVSVLQYGSITTIDVPWNVAMEKAHLLSLVDVMQREGGPSQIGNALDFAVRYLTSEVHGARPGASKAVVILVTDVSVDSVGAAADAARANRVTVFPIGIGDRYDAAQLRILAGPAANSNVVSLQRIEDLPTTVTLGNSFLHKLCSGFVRICMDEDGNEKRPGDVWTLPDQCHTVTCQPDGQTLLKSHRVNCDRGPRPSCPNSQSPVKVEETCGCRWTCPCVCTGSSTRHIVTFDGQNFKLTGSCSYVLFQNKEQDLEVILHNGACSPGARQGCMKSIEVKHSALSVELHSDMEVAVNGRLVSVPYVGGNMEVSVYGAIMHEIRFNHLGHIFTFTPQNNEFQLQLSPKTFASKTYGLCGICDENGANDFVLRDGTVTTDWKTLVQEWTVQQSGQTCQPILEEQCPVSDSSQCQVLLSALFAECHKVLAPATFYAICQQDSCHREQVCEVIASYAHLCRTSGVCVDWRTPDFCAMSCPSSLVYNHCERGCPQHCDGNVSSCGDHPSEGCFCPPNQVMLEGSCVPKEACTQCIGEDGVRHQFLEAWVPDHQPCQICTCLSGRKVNCTTQPCPTAKAPTCGLCEVARLRQNAEQCCPEYECVCDPVSCDLPVVPHCEGGLQPMLTNPGECRPNFTCACRKEECERVSPPSCPPHRFLTLRKTQCCDEYECACNCVNSTVSCPLGYLASTATNDCGCTTTTCLPDKVCVHRGTIYPVGQFWEEGCDVCTCTDMEDAVMGLRVAQCSQKPCEDSCRSGFTYVLHEGECCGRCLPSACEVVMGSRRGDSQSSWKSVGSHWASLENPCLINECVRVKEEVFVQQRNVSCPQLEVPFCPPGFQLSCKTSECCPRCRCEPVEACMLNGTIIGPGKSVMVDVCTACHCIVEAGATSGFQLECRKTTCKPCPPGYKEENNPGECCGRCLPTACTIRLRGGQIMTLKRDETLQDGCDSHSCKVNEIGEYIWEKRVASCPPFDEHKCLAEGGKIMKTPDTCCDRCEVPECKDITARLQYVKVGSCKSEVEVDIHYCQGKCASKAMYSIDIEDVQDQCSCCSPTRTEPMRVPLLCTNGSVVYHEVLNAMQCKCSPRKCSK

SEQ ID NO: 142 - protein, 2823 aa, Papio anubis
MPCQRKVAALLMIPARLAGVLLALALVLPGTFCAEGTRGRSSMARCSLFGSDFINTFDGSMYSFAGYCSYLLAGDCQKRSFSIIGDFQSGKRASLSVYLGEFFDIRLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAEGLECTCPAFLEYARTCAHEGMVLYGWTDHSACSPVCPAGMEYKQCVSPCARTCQSLHINEVCQERCMDGCSCPEGQLLDEGLCVESTECPCMHSGKRYPPSASLSRDCNTCICRNSQWICSNEECPGECLVTGQSHFKSFDNRYFTFSGICQYLLARDCQDHSFSIVIETVQCADDPDAVCTRSVTIRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAISPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGGDPGTFRILVGNEGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPADFGNSWKVSSQCADTRKVPLDSSPATCHNNLMKQTMVDSSCRVLTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACKEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLIEKQSPDNKAFVLSGVDELEQQRDEIVSYLCDLAPEAPPPTLPPDMAQVTVGPGLLGVSTLGPKRNSMVLDVAFVLEGSDKIGEADFNRSKEFMEEVIQRMDVGQDGIHVAVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVALEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHGALSVELHSDMEVTVNGRLVSVPYVGGNMEVNVYGAIMHEIRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCWTNGVCVDWRTPDFCAMSCPPSLVYNPCERGCPRHCDGNVSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGFQPTLTNPGECRPNFTCACRKEECKRVSPPSCPPHRLPALRKTQCCDEYECACNCVNSTVSCPLGYLASTATNDCGCTTTTCLPDKVCVHRSTIYPMGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPLGFQLSCKTSACCPSCHCEPVEACMLNGTMIGPGKSVMIDACTTCRCIVQVGIISGFKLECRKTICNPCPLGYKEENNTGECCGRCLPTTCTIRLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 143 - protein, 2812 aa, Papio anubis
MIPARLAGVLLALALVLPGTFCAEGTRGRSSMARCSLFGSDFINTFDGSMYSFAGYCSYLLAGDCQKRSFSIIGDFQSGKRASLSVYLGEFFDIRLFVNGTVTQGDKSVSMPYASKGLYLETEAGYYKLSGEAYGFVARIDGSGNFQVLLSDRYFNKTCGLCGNFNIFAEDDFMTQEGTVTSDPYDFANSWALSSGEQWCERASPPSSSCNISSGEVQKGLWEQCQLLKSTSVFARCHPLVDPEPFVALCEKTSCECAEGLECTCPAFLEYARTCAHEGMVLYGWTDHSACSPVCPAGMEYKQCVSPCARTCQSLHINEVCQERCMDGCSCPEGQLLDEGLCVESTECPCMHSGKRYPPSASLSRDCNTCICRNSQWICSNEECPGECLVTGQSHFKSFDNRYFTFSGICQYLLARDCQDHSFSIVIETVQCADDPDAVCTRSVTIRLPGLHNSLVKLKHGGGVAMDGQDVQLPLLKGDLRIQHSVTASVRLSYGEDLQMDWDGRGRLLVKLSPVYAGKTCGLCGNYNGNQGDDFLTPSGLAEPRVEDFGNAWKLHADCQDLQKQHSDPCALNPRMTRFSEEACAVLTSPTFEACHRAISPLPYLRNCRYDVCSCSDGRECLCGALASYAAACAGRGVRVAWREPGRCELKCPKGQVYLQCGTPCNLTCRALSYPDEECNEACLEGCFCPPGLYMDEMGDCVPKAQCPCYYDGEIFQPEDIFSDHHTMCYCEDGFMHCTMSGVPGSLLPDAVLSSPLSHRSKRSLSCRPPMVKLVCPADNPRAEGLECAKTCQNYDLECMSMGCVSGCLCPPGMVRHENRCVALERCPCFHQGKEYAPGEAVKIDCNTCVCRDRKWNCTDHVCDATCSTIGMAHYLTFDGLKYMFPGECQYVLVQDYCGGDPGTFRILVGNEGCSHPSVKCKKRVTILVEGGEIELFDGEVNVKRPMKDETHFEVVESGRYIILLLGKALSVVWDRHLSISVVLKQTYQEKVCGLCGNFDGIQNNDLTSSNLQVEEDPADFGNSWKVSSQCADTRKVPLDSSPATCHNNLMKQTMVDSSCRVLTSDVFQDCNKLVDPEPFLDVCIYDTCSCESIGDCACFCDTIAAYAHVCAQHGKVVTWRTATLCPQSCEERNLRENGYECEWRYNSCAPACRVTCQHPEPLACPVQCVEGCHAHCPPGKILDELLQTCVSPEDCPVCEAAGRRFASGKKVTLNPSDPEHCQICHCDGVNLTCEACKEPGGLVVPPTDAPVSPTTPYVEDISEPPLHDFYCSRLLDLVFLLDGSSRLSEAEFEVLKAFVVDMMERLRISQKWVRVAVVEYHDGSHAYIGLKDRKRPSELRRIASQVKYAGSQVASTSEVLKYTLFQIFGKIDRPEASRIALLLMASQEPQRMSRNFVRYVQGLKKKKVIVIPVGIGPHANLKQIRLIEKQSPDNKAFVLSGVDELEQQRDEIVSYLCDLAPEAPPPTLPPDMAQVTVGPGLLGVSTLGPKRNSMVLDVAFVLEGSDKIGEADFNRSKEFMEEVIQRMDVGQDGIHVAVLQYSYTVAVEYPFSEAQSKGDILQRVREIRYQGGNRTNTGLALQYLSEHSFLVSQGDREQAPNLVYMVTGNPASDEIKRLPGDIQVVPIGVGPHANVQELERIGWPNAPILIQDFETLPREAPDLVLQSCCSGEGLKIPTLSPAPDCSQPLDVILLLDGSSSFPAAYFDEMKSFAKAFISKANIGPHLTQVSVLQYGSITTIDVPWNVALEKAHLLSLVDVMQREGGPSQIGDALGFAVRYLTSEMHGARPGASKAVVILVMDVSVDAVDAAADAARSNRVTVFPIGIGDRYDAAQLRILAGPAGNSNVVKLQRIEDLPTMVTLGNSFLHKLCSGFVRICMDEDGNERRPGDIWTLPDQCHTVTCQPDGQTLLKSHRVNCDRGLRPSCPNSQSPVKVEETCGCRWTCPCVCTGSSTRHIVTFDGQNFKLTGSCSYVLFQNKEQDLEVILHNGACSPAARQGCMKSIEVKHGALSVELHSDMEVTVNGRLVSVPYVGGNMEVNVYGAIMHEIRFNHLGHIFTFTPQNNEFQLQLSPKTFASKTYGLCGICDENGANDFMLRDGTVTTDWKTLVQEWTVQRPGQTCQPILEEQCLVPNSSQCQVLLSALFAECHKVLAPATFYAICQQDSCHREQVCEVIASYAHLCWTNGVCVDWRTPDFCAMSCPPSLVYNPCERGCPRHCDGNVSCGDHPSEGCFCPPNKVMLEGSCVPEEACTQCIGEDGVQHQFLEAWVPDHQPCQICTCLSGRKANCTMQPCPTAKAPTCGLCEVARLRQNADQCCPEYECVCDPESCDLPPVPHCEGGFQPTLTNPGECRPNFTCACRKEECKRVSPPSCPPHRLPALRKTQCCDEYECACNCVNSTVSCPLGYLASTATNDCGCTTTTCLPDKVCVHRSTIYPMGQFWEEGCDVCTCTDMEDAVMGLRVVQCSQKPCEDSCRSGFTYVPREGECCGRCLPSACEVVTGSPRGDSQSSWKSVGSHWASPENPCLINECVRVKEEVFVQQRNVSCPQLEVPVCPLGFQLSCKTSACCPSCHCEPVEACMLNGTMIGPGKSVMIDACTTCRCIVQVGIISGFKLECRKTICNPCPLGYKEENNTGECCGRCLPTTCTIRLRGGQIMTLKRDETLQDGCDTHFCKVNERGEYFWEKRVTGCPPFDEHKCLAEGGKIMKIPGTCCDTCEEPECNDITARLQYVKVGSCKSEVEVDIHYCQGKCASKAMYSIDINDVQDQCSCCSPTRTEPMQVPLHCTNGSVVYHEVLNAMQCECSPRKCSK

SEQ ID NO: 144 - protein, 21 aa, Artificial sequence
  synthetic amino acid sequence
FMYVAAAAFVLLFFVGCGVLL

SEQ ID NO: 145 - protein, 21 aa, Artificial sequence
  synthetic amino acid sequence
LLYLLAVAVVIILFIILLGVI

SEQ ID NO: 146 - protein, 21 aa, Artificial sequence
  synthetic amino acid sequence
LPLLVAGAVLLLVILVLGVMV

SEQ ID NO: 147 - protein, 21 aa, Artificial sequence
  synthetic amino acid sequence
PVLCSPVAGVILLALGALLVL

SEQ ID NO: 148 - protein, 21 aa, Artificial sequence
  synthetic amino acid sequence
LMYVAAAAFVLLFFVGCGVLL

SEQ ID NO: 149 - protein, 21 aa, Artificial sequence
  synthetic amino acid sequence
LLYLLAVAVVIILFFILLGVI

SEQ ID NO: 150 - protein, 21 aa, Artificial sequence
  synthetic amino acid sequence
LLPLLVAGAVFLLIIFILGVM

SEQ ID NO: 151 - protein, 21 aa, Artificial sequence
  synthetic amino acid sequence
PILCSPVVGVLLLALGALLVL

SEQ ID NO: 152 - protein, 23 aa, Artificial sequence
  synthetic amino acid sequence
LHLMYVAAAAFVLLFFVGCGVLL

SEQ ID NO: 153 - protein, 21 aa, Artificial sequence
  synthetic amino acid sequence
LLYLLAVAVVIILFLILLGVI

SEQ ID NO: 154 - protein, 21 aa, Artificial sequence
  synthetic amino acid sequence
LPLLVAGAVFLLVIFVLGVMV

SEQ ID NO: 155 - protein, 8 aa, Artificial sequence
  synthetic amino acid sequence
VGCGVLLS

SEQ ID NO: 156 - protein, 7 aa, Artificial sequence
  synthetic amino acid sequence
GCGVLLS

SEQ ID NO: 157 - protein, 4 aa, Artificial sequence
  synthetic amino acid sequence
  misc_feature (2)..(2): Xaa can be any naturally occurring amino acid
  MISC_FEATURE (3)..(3): Arg/Lys
RXXR

SEQ ID NO: 158 - protein, 10 aa, Artificial sequence
  synthetic amino acid sequence
GRRRRELDPM

SEQ ID NO: 159 - protein, 9 aa, Artificial sequence
  synthetic amino acid sequence
RQRRELDPM

SEQ ID NO: 160 - protein, 8 aa, Artificial sequence
  synthetic amino acid sequence
KIEAVKSE

SEQ ID NO: 161 - protein, 8 aa, Artificial sequence
  synthetic amino acid sequence
KIEAVQSE

SEQ ID NO: 162 - protein, 4 aa, Artificial sequence
  synthetic amino acid sequence
SQLH

SEQ ID NO: 163 - protein, 14 aa, Artificial sequence
  synthetic amino acid sequence
KSEPVEPPLPSQLH

SEQ ID NO: 164 - protein, 6 aa, Artificial sequence
  synthetic amino acid sequence
SRKRRR

SEQ ID NO: 165 - protein, 13 aa, Artificial sequence
  synthetic amino acid sequence
SRKRRRQLCIQKL

SEQ ID NO: 166 - protein, 32 aa, Artificial sequence
  synthetic amino acid sequence
SRKRRRQHGQLWFPEGFKVSEASKKKRREPLG

SEQ ID NO: 167 - protein, 31 aa, Artificial sequence
  synthetic amino acid sequence
SQLHLMYVAAAAFVLLFFVGCGVLLSRKRRR

SEQ ID NO: 168 - protein, 41 aa, Artificial sequence
  synthetic amino acid sequence
KSEPVEPPLPSQLHLMYVAAAAFVLLFFVGCGVLLSRKRRR

SEQ ID NO: 169 - protein, 53 aa, Artificial sequence
  synthetic amino acid sequence
FMYVAAAAFVLLFFVGCGVLLSRKRRRQHGQLWFPEGFKVSEASKKKRREPLG

SEQ ID NO: 170 - protein, 9 aa, Artificial sequence
  synthetic amino acid sequence
RMFPNAPYL

SEQ ID NO: 171 - protein, 10 aa, Artificial sequence
  synthetic amino acid sequence
KLVVVGAGGV

SEQ ID NO: 172 - protein, 10 aa, Artificial sequence
  synthetic amino acid sequence
KLVVVGAVGV

SEQ ID NO: 173 - protein, 10 aa, Artificial sequence
  synthetic amino acid sequence
KLVVVGACGV

SEQ ID NO: 174 - protein, 10 aa, Artificial sequence
  synthetic amino acid sequence
KLVVVGADGV

SEQ ID NO: 175 - protein, 9 aa, Artificial sequence
  synthetic amino acid sequence
VVGAVGVGK

SEQ ID NO: 176 - protein, 9 aa, Artificial sequence
  synthetic amino acid sequence
VVGACGVGK

SEQ ID NO: 177 - protein, 9 aa, Artificial sequence
  synthetic amino acid sequence
VVGAGGVGK

SEQ ID NO: 178 - protein, 9 aa, Artificial sequence
  synthetic amino acid sequence
KITDFGLAK

SEQ ID NO: 179 - protein, 9 aa, Artificial sequence
  synthetic amino acid sequence
KITDFGRAK

SEQ ID NO: 180 - protein, 9 aa, Artificial sequence
  synthetic amino acid sequence
VLQELNVTV

SEQ ID NO: 181 - protein, 9 aa, Artificial sequence
  synthetic amino acid sequence
EADPTGHSY

SEQ ID NO: 182 - protein, 9 aa, Artificial sequence
  synthetic amino acid sequence
FLWGPRALV

SEQ ID NO: 183 - protein, 9 aa, Artificial sequence
  synthetic amino acid sequence
LLGRNSFEV

SEQ ID NO: 184 - protein, 10 aa, Artificial sequence
  synthetic amino acid sequence
STTPPPGTRV

SEQ ID NO: 185 - protein, 9 aa, Artificial sequence
  synthetic amino acid sequence
RMPEAAPPV

SEQ ID NO: 186 - protein, 11 aa, Artificial sequence
  synthetic amino acid sequence
GLAPPQHLIRV

SEQ ID NO: 187 - protein, 10 aa, Artificial sequence
  synthetic amino acid sequence
ELAGIGILTV

SEQ ID NO: 188 - protein, 10 aa, Artificial sequence
  synthetic amino acid sequence
EAAGIGILTV

SEQ ID NO: 189 - protein, 9 aa, Artificial sequence
  synthetic amino acid sequence
IMDQVPFSV

SEQ ID NO: 190 - protein, 9 aa, Artificial sequence
  synthetic amino acid sequence
KTWGQYWQV

SEQ ID NO: 191 - protein, 9 aa, Artificial sequence
  synthetic amino acid sequence
YLEPGPVTV

SEQ ID NO: 192 - protein, 9 aa, Artificial sequence
  synthetic amino acid sequence
YLEPGPVTA

SEQ ID NO: 193 - protein, 9 aa, Artificial sequence
  synthetic amino acid sequence
ITDQVPFSV

SEQ ID NO: 194 - protein, 9 aa, Artificial sequence
  synthetic amino acid sequence
NLVPMVATV

SEQ ID NO: 195 - protein, 9 aa, Artificial sequence
  synthetic amino acid sequence
AIIRILQQL

SEQ ID NO: 196 - protein, 9 aa, Artificial sequence
  synthetic amino acid sequence
VLHDDLLEA

SEQ ID NO: 197 - protein, 9 aa, Artificial sequence
  synthetic amino acid sequence
VLRDDLLEA

SEQ ID NO: 198 - protein, 9 aa, Artificial sequence
  synthetic amino acid sequence
SLLMWITQV

SEQ ID NO: 199 - protein, 10 aa, Artificial sequence
  synthetic amino acid sequence
LLDFVRFMGV

SEQ ID NO: 200 - protein, 9 aa, Artificial sequence
  synthetic amino acid sequence
FMNKFIYEI

SEQ ID NO: 201 - protein, 9 aa, Artificial sequence
  synthetic amino acid sequence
KIFGSLAFL

SEQ ID NO: 202 - protein, 9 aa, Artificial sequence
  synthetic amino acid sequence
GVLPALPQV

SEQ ID NO: 203 - protein, 9 aa, Artificial sequence
  synthetic amino acid sequence
TMTRVLQGV

SEQ ID NO: 204 - protein, 9 aa, Artificial sequence
  synthetic amino acid sequence
FLLTRILTI

SEQ ID NO: 205 - protein, 9 aa, Artificial sequence
  synthetic amino acid sequence
ILAKFLHWL

SEQ ID NO: 206 - protein, 9 aa, Artificial sequence
  synthetic amino acid sequence
RLVDDFLLV

SEQ ID NO: 207 - protein, 9 aa, Artificial sequence
  synthetic amino acid sequence
LLLTVLTVV

SEQ ID NO: 208 - protein, 9 aa, Artificial sequence
  synthetic amino acid sequence
FLRNFSLML

SEQ ID NO: 209 - protein, 9 aa, Artificial sequence
  synthetic amino acid sequence
YMDGTMSQV

SEQ ID NO: 210 - protein, 9 aa, Artificial sequence
  synthetic amino acid sequence
YLLPAIVHI

SEQ ID NO: 211 - protein, 9 aa, Artificial sequence
  synthetic amino acid sequence
FLSELTQQL

SEQ ID NO: 212 - protein, 10 aa, Artificial sequence
  synthetic amino acid sequence
ALYVDSLFFL

SEQ ID NO: 213 - protein, 248 aa, Artificial sequence
  synthetic amino acid sequence
MSRLDKSKVINSALELLNEVGIEGLTTRKLAQKLGVEQPTLYWHVKNKRALLDALAIEMLDRHHTHFCPLEGESWQDFLRNNAKSFRCALLSHRDGAKVHLGTRPTEKQYETLENQLAFLCQQGFSLENALYALSAVGHFTLGCVLEDQEHQVAKEERETPTTDSMPPLLRQAIELFDHQGAEPAFLFGLELIICGLEKQLKCESGGPADALDDFDLDMLPADALDDFDLDMLPADALDDFDLDMLPG

SEQ ID NO: 214 - protein, 211 aa, Artificial sequence
  synthetic amino acid sequence
MKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 215 - protein, 115 aa, Artificial sequence
  synthetic amino acid sequence
PKKKRKVDALDDFDLDMLGSDALDDFDLDMLGSDALDDFDLDMLGSDALDDFDLDMLGSGGSGGSGGSLEIEAAFLERENTALETRVAELRQRVQRLRNRVSQYRTRYGPLGGGK

SEQ ID NO: 216 - protein, 5 aa, Artificial sequence
  synthetic amino acid sequence
GGGGS

SEQ ID NO: 217 - protein, 282 aa, Artificial sequence
  synthetic amino acid sequence
METLLGLLILWLQLQWVSSKQEVTQIPAALSVPEGENLVLNCSFTDSAIYNLQWFRQDPGKGLTSLLLIQSSQREQTSGRLNASLDKSSGRSTLYIAASQPGDSATYLCAVRPLLDGTYIPTFGRGTSLIVHPGSADDAKKDAAKKDGKSMSIGLLCCAALSLLWAGPVNAGVTQTPKFQVLKTGQSMTLQCAQDMNHEYMSWYRQDPGMGLRLIHYSVGAGTTDRGEVPNGYNVSRSTIEDFPLRLLSAAPSQTSVYFCASSYVGDTGELFFGEGSRLTVL

SEQ ID NO: 218 - protein, 9 aa, Artificial sequence
  synthetic amino acid sequence
YPYDVPDYA

SEQ ID NO: 219 - protein, 8 aa, Artificial sequence
  synthetic amino acid sequence
DYKDDDDK

SEQ ID NO: 220 - protein, 10 aa, Artificial sequence
  synthetic amino acid sequence
EQKLISEEDL

SEQ ID NO: 221 - protein, 5 aa, Artificial sequence
  synthetic amino acid sequence
HHHHH

SEQ ID NO: 222 - protein, 6 aa, Artificial sequence
  synthetic amino acid sequence
HHHHHH

SEQ ID NO: 223 - protein, 10 aa, Artificial sequence
  synthetic amino acid sequence
EQKLISEEDL

SEQ ID NO: 224 - protein, 8 aa, Artificial sequence
  synthetic amino acid sequence
DYKDDDDK

SEQ ID NO: 225 - protein, 8 aa, Artificial sequence
  synthetic amino acid sequence
WSHPQFEK

SEQ ID NO: 226 - protein, 9 aa, Artificial sequence
  synthetic amino acid sequence
YPYDVPDYA

SEQ ID NO: 227 - protein, 5 aa, Artificial sequence
  synthetic amino acid sequence
RYIRS

SEQ ID NO: 228 - protein, 4 aa, Artificial sequence
  synthetic amino acid sequence
FHHT

SEQ ID NO: 229 - protein, 17 aa, Artificial sequence
  synthetic amino acid sequence
WEAAAREACCRECCARA

SEQ ID NO: 230 - protein, 7 aa, Artificial sequence
  synthetic amino acid sequence
PKKKRKV

SEQ ID NO: 231 - protein, 16 aa, Artificial sequence
  synthetic amino acid sequence
KRPAATKKAGQAKKKK

SEQ ID NO: 232 - protein, 8 aa, Artificial sequence
  synthetic amino acid sequence
MVPKKKRK

SEQ ID NO: 233 - protein, 17 aa, Artificial sequence
  synthetic amino acid sequence
MAPKKKRKVGIHGVPAA

SEQ ID NO: 234 - protein, 736 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPLMYVAAAAFVLLFFVGCGVLLSRKRRRQHGQLWFPEGFKVSEASKKKRREPLGMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 235 - protein, 736 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPGLLGVSTLGPKRNSMVLDVAFVLEGSDKIGEADFNRSKEFMEEVIQRMDVGQDSIHVTVLQYSYMVTVEYPFSEAQSKGDILQRVREIRYQGGNRTNTGLALRYLSDHSFLVSQGDREQAPNLVYMVTGNPASDEIKRLPGDIQVVPIGVGPNANVQELERIGWPNAPILIQDFETLPREAPDLVLQRCCSGEGLQIPFMYVAAAAFVLLFFVGCGVLLSRKRRRQHGQLWFPEGFKVSEASKKKRREPLGMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 236 - protein, 724 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPKSEPVEPPLPSQLHLMYVAAAAFVLLFFVGCGVLLSRKRRRMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 237 - protein, 714 aa, Artificial sequence
  synthetic amino acid sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPSQLHLMYVAAAAFVLLFFVGCGVLLSRKRRRMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 238 - protein, 2555 aa, Homo sapiens; identical to SEQ ID NO: 1

SEQ ID NO: 239 - protein, 2531 aa, Mus musculus; identical to SEQ ID NO: 2

SEQ ID NO: 240 - protein, 660 aa, Homo sapiens
MFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 241 - protein, 430 aa, Artificial sequence
  synthetic amino acid sequence
MVSKGEEDNSDVWWGGADTDYADGSEDKVVEVAEEEEVAEVEEEEADDDEDDEDGDEVEEEAEEPYEEATERTTSIATTTTTTTESVEEVVRVPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVNLDAEFRHDSGYEVHHQKLVFFAEDVGSNKGR

SEQ ID NO: 242 - protein, 254 aa, Homo sapiens
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 243 - protein, 194 aa, Artificial sequence
  synthetic amino acid sequence
GMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVR

SEQ ID NO: 244 - protein, 780 aa, Mus musculus
MDKFWWHTAWGLCLLQLSLAHPHQQIDLNVTCRYAGVFHVEKNGRYSISRTEAADLCQAFNSTLPTMDQMKLALSKGFETCRYGFIEGNVVIPRIHPNAICAANHTGVYILVTSNTSHYDTYCFNASAPPEEDCTSVTDLPNSFDGPVTITIVNRDGTRYSKKGEYRTHQEDIDASNIIDDDVSSGSTIEKSTPESYILHTYLPTEQPTGDQDDSFFIRSTLATIASTVHSKSHAAAQKQNNWIWSWFGNSQSTTQTQEPTTSATTALMTTPETPPKRQEAQNWFSWLFQPSESKSHLHTTTKMPGTESNTNPTGWEPNEENEDETDKYPSFSGSGIDDDEDFISSTIASTPRVSARTEDNQDWTQWKPNHSNPEVLLQTTTRMADIDRISTSAHGENWTPEPQPPFNNHEYQDEEETPHATSTTPNSTAEAAATQQETWFQNGWQGKNPPTPSEDSHVTEGTTASAHNNHPSQRITTQSQEDVSWTDFFDPISHPMGQGHQTESKDTDSSHSTTLQPTAAPNTHLVEDLNRTGPLSVTTPQSHSQNFSTLHGEPEEDENHPTTSILPSSTKSGAKDARRGGSLPTDTTTSVEGYTFQYPDTMENGTLFPVTPAKTEVFGETEVTLATDSNVNVDGSLPGDRDSSKDSRGSSRTVTHGSELAGHSSANQDSGVTTTSGPMRRPQIPEWLIILASLLALALILAVCIAVNSRRRCGQKKKLVINGGNGTVEDRKPSELNGEASKSQEMVHLVNKEPSETPDQCMTADETRNLQSVDMKIGV

SEQ ID NO: 245 - protein, 461 aa, Artificial sequence
  synthetic amino acid sequence
PRHSKSHAAAQKQNNWIWSWFGNSQSTTQTQEPTTSATTALMTTPETPPKRQEAQNWFSWLFQPSESKSHLHTTTKMPGTESNTNPTGWEPNEENEDETDKYPSFSGSGIDDDEDFISSTIASTPRVSARTEDNQDWTQWKPNHSNPEVLLQTTTRMADIDRISTSAHGENWTPEPQPPFNNHEYQDEEETPHATSTTPNSTAEAAATQQETWFQNGWQGKNPPTPSEDSHVTEGTTASAHNNHPSQRITTQSQEDVSWTDFFDPISHPMGQGHQTESKDTDSSHSTTLQPTAAPNTHLVEDLNRTGPLSVTTPQSHSQNFSTLHGEPEEDENHPTTSILPSSTKSGAKDARRGGSLPTDTTTSVEGYTFQYPDTMENGTLFPVTPAKTEVFGETEVTLATDSNVNVDGSLPGDRDSSKDSRGSSRTVTHGSELAGHSSANQDSGVTTTSGPMRRPQIPER

SEQ ID NO: 246 - protein, 880 aa, Drosophila melanogaster
MHWINCLLTAFICFTVIVQVHSSGSFELRLKYFSNDHGRDNEGRCCSGESDGATGKCLGSCKTRFRLCLKHYQATIDTTSQCTYGDVITPILGENSVNLTDAQRFQNKGFTNPIQFPFSFSWPGTFSLIVEAWHDTNNSGNARTNKLLIQRLLVQQVLEVSSEWKTNKSESQYTSLEYDFRVTCDLNYYGSGCAKFCRPRDDSFGHSTCSETGEIICLTGWQGDYCHIPKCAKGCEHGHCDKPNQCVCQLGWKGALCNECVLEPNCIHGTCNKPWTCICNEGWGGLYCNQDLNYCTNHRPCKNGGTCFNTGEGLYTCKCAPGYSGDDCENEIYSCDADVNPCQNGGTCIDEPHTKTGYKCHCRNGWSGKMCEEKVLTCSDKPCHQGICRNVRPGLGSKGQGYQCECPIGYSGPNCDLQLDNCSPNPCINGGSCQPSGKCICPSGFSGTRCETNIDDCLGHQCENGGTCIDMVNQYRCQCVPGFHGTHCSSKVDLCLIRPCANGGTCLNLNNDYQCTCRAGFTGKDCSVDIDECSSGPCHNGGTCMNRVNSFECVCANGFRGKQCDEESYDSVTFDAHQYGATTQARADGLANAQVVLIAVFSVAMPLVAVIAACVVFCMKRKRKRAQEKDNAEARKQNEQNAVATMHHNGSAVGVALASASMGGKTGSNSGLTFDGGNPNIIKNTWDKSVNNICASAAAAAAAAAAADECLMYGGYVASVADNNNANSDFCVAPLQRAKSQKQLNTDPTLMHRGSPAGTSAKGASGGGPGAAEGKRISVLGEGSYCSQRWPSLAAAGVAGDLFIQLMAAASVAGTDGTAQQQRSVVCGTPHYVTPKIRKGSWEIRRNPHGGADSTYTKKRLGWVQNVRETPKMLLLIEAV

SEQ ID NO: 247 - protein, 34 aa, Artificial sequence
  synthetic amino acid sequence
PRDEESYDSVTFDAHQYGATTQARADGLANAQVR

SEQ ID NO: 248 - protein, 884 aa, Mus musculus
MGARCRSFSALLLLLQVSSWLCQELEPESCSPGFSSEVYTFPVPERHLERGHVLGRVRFEGCTGRPRTAFFSEDSRFKVATDGTITVKRHLKLHKLETSFLVRARDSSHRELSTKVTLKSMGHHHHRHHHRDPASESNPELLMFPSVYPGLRRQKRDWVIPPISCPENEKGEFPKNLVQIKSNRDKETKVFYSITGQGADKPPVGVFIIERETGWLKVTQPLDREAIAKYILYSHAVSSNGEAVEDPMEIVITVTDQNDNRPEFTQPVFEGFVAEGAVPGTSVMKVSATDADDDVNTYNAAIAYTIVSQDPELPHKNMFTVNRDTGVISVLTSGLDRESYPTYTLVVQAADLQGEGLSTTAKAVITVKDINDNAPVFNPSTYQGQVPENEVNARIATLKVTDDDAPNTPAWKAVYTVVNDPDQQFVVVTDPTTNDGILKTAKGLDFEAKQQYILHVRVENEEPFEGSLVPSTATVTVDVVDVNEAPIFMPAERRVEVPEDFGVGQEITSYTAREPDTFMDQKITYRIWRDTANWLEINPETGAIFTRAEMDREDAEHVKNSTYVALIIATDDGSPIATGTGTLLLVLLDVNDNAPIPEPRNMQFCQRNPQPHIITILDPDLPPNTSPFTAELTHGASVNWTIEYNDAAQESLILQPRKDLEIGEYKIHLKLADNQNKDQVTTLDVHVCDCEGTVNNCMKAGIVAAGLQVPAILGILGGILALLILILLLLLFLRRRTVVKEPLLPPDDDTRDNVYYYDEEGGGEEDQDFDLSQLHRGLDARPEVTRNDVAPTLMSVPQYRPRPANPDEIGNFIDENLKAADSDPTAPPYDSLLVFDYEGSGSEAASLSSLNSSESDQDQDYDYLNEWGNRFKKLADMYGGGEDD

SEQ ID NO: 249 - protein, 163 aa, Artificial sequence
  synthetic amino acid sequence
AEMDREDAEHVKNSTYVALIIATDDGSPIATGTGTLLLVLLDVNDNAPIPEPRNMQFCQRNPQPHIITILDPDLPPNTSPFTAELTHGASVNWTIEYNDAAQESLILQPRKDLEIGEYKIHLKLADNQNKDQVTTLDVHVCDCEGTVNNCMKAGIVAAGLQVR

SEQ ID NO: 250 - protein, 987 aa, Mus musculus
MAVRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDLATKTFPNWMENPWVKVDTIAADESFSQVDLGGRVMKINTEVRSFGPVSRNGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKQELSEYNATAIKSPTNTVTVQGLKAGAIYVFQVRARTVAGYGRYSGKMYFQTMTEAEYQTSIKEKLPLIVGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 251 - protein, 336 aa, Mus musculus
MAMARSRRDSVWKYCWGLLMVLCRTAISRSIVLEPIYWNSSNSKFLPGQGLVLYPQIGDKLDIICPKVDSKTVGQYEYYKVYMVDKDQADRCTIKKENTPLLNCARPDQDVKFTIKFQEFSPNLWGLEFQKNKDYYIISTSNGSLEGLDNQEGGVCQTRAMKILMKVGQDASSAGSARNHGPTRRPELEAGTNGRSSTTSPFVKPNPGSSTDGNSAGHSGNNLLGSEVALFAGIASGCIIFIVIIITLVVLLLKYRRRHRKHSPQHTTTLSLSTLATPKRGGNNNGSEPSDVIIPLRTADSVFCPHYEKVSGDYGHPVYIVQEMPPQSPANIYYKV

SEQ ID NO: 252 - protein, 209 aa, Mus musculus
MAPAQRPLLPLLLLLLPLRARNEDPARANADRYAVYWNRSNPRFQVSAVGDGGGYTVEVSINDYLDIYCPHYGAPLPPAERMERYILYMVNGEGHASCDHRQRGFKRWECNRPAAPGGPLKFSEKFQLFTPFSLGFEFRPGHEYYYISATPPNLVDRPCLRLKVYVRPTNETLYEAPEPIFTSNSSCSGLGGCHLFLTTVPVLWSLLGS

SEQ ID NO: 253 - protein, 342 aa, Artificial sequence
  synthetic amino acid sequence
NGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKQELSEYNATAIKSPTNTVTVQGLKAGAIYVFQVRARTVAGYGRYSGKMYFQTMTEAEYQTSIKEKLPR

SEQ ID NO: 254 - protein, 110 aa, Artificial sequence
  synthetic amino acid sequence
APSAVSIMHQVSRTVDSITLSWSQPDQPNGVILDYELQYYEKQELSEYNATAIKSPTNTVTVQGLKAGAIYVFQVRARTVAGYGRYSGKMYFQTMTEAEYQTSIKEKLPR

SEQ ID NO: 255 - protein, 233 aa, Artificial sequence
  synthetic amino acid sequence
MAMARSRRDSVWKYCWGLLMVLCRTAISRSIVLEPIYWNSSNSKFLPGQGLVLYPQIGDKLDIICPKVDSKTVGQYEYYKVYMVDKDQADRCTIKKENTPLLNCARPDQDVKFTIKFQEFSPNLWGLEFQKNKDYYIISTSNGSLEGLDNQEGGVCQTRAMKILMKVGQDASSAGSARNHGPTRRPELEAGTNGRSSTTSPFVKPNPGSSTDGNSAGHSGNNLLGSEVALFAR

SEQ ID NO: 256 - protein, 47 aa, Artificial sequence
  synthetic amino acid sequence
VYVRPTNETLYEAPEPIFTSNSSCSGLGGCHLFLTTVPVLWSLLGSR

SEQ ID NO: 257 - protein, 66 aa, Artificial sequence
  synthetic amino acid sequence
GQDASSAGSARNHGPTRRPELEAGTNGRSSTTSPFVKPNPGSSTDGNSAGHSGNNLLGSEVALFAR

SEQ ID NO: 258 - protein, 6619 aa, Drosophila melanogaster
  misc_feature (5964)..(5964): Xaa can be any naturally occurring amino acid
  misc_feature (6074)..(6074): Xaa can be any naturally occurring amino acid
  misc_feature (6252)..(6252): Xaa can be any naturally occurring amino acid
MERLLLLFFLLLAGRESLCQTGDTKLELLAPRGRSYATTYEQYAAFPRRRSSSSSPSGEMQSRAVDTSADFEVLEGQPRGTTVGFIPTKPKFSYRFNEPPREFTLDPVTGEVKTNVVLDREGMRDHYDLVVLSSQPTYPIEVRIKVLDVNDNSPEFPEPSIAISFSESATSGTRLLLDAATDADVGENGVTDQYEIVAGNVDNKFRLVTTANPSGDTSYLHLETTGNLDRESRGSYQLNISARDGGSPPRFGYLQVNVTILDVNDNPPIFDHSDYNVSLNETALPGTPVVTVMASDNDLGDNSKITYYLAETEHQFTVNPETGVISTTERVNCPQQTNVKSSASQKSCVFTVFARDHGSPRQDGRTYVTVNLLDTNDHDPIISFRFFPDGGKVATVDENAVNGTVVAAVAVKDSDSGLNGRTSVRIVSGNELGHFRLEEAADLHIVRVNGVLDREEIGKYNLTVVAMDQGTPARTTTAHLIIDVNDVNDHEPVFEKSEYSAVLSELAPTGSFVASITATDEDTGVNAQVHYDILSGNELKWFSMDPLTGLIVTTGPLDREIRDTVELSISARDGGPNPKFAYTQLKVIILDENDEAPQFSQREQNVTLGEDAPPQTIVALMTATDHDQGTNGSVTFALAPSVERLYPLQFALDALTGQLTTRRPLDREKMSQYEISVIARDQGAPTPQSATATVWLNVADVNDNDPQFYPRHYIYSLADDDDDIKLKKEVEKERILLHVTASDKDDGDNALIEYRLESGGEGLFQLDARSGAISLRGDAPASMHWKPHYKLLVSARDAGQRRSQQDAIVEIVLKSKLEMLECGQAQAGGYEFQMVEDHEQQRNSQPNREVGIVQVKSTNGKANSHIEYDIIQGDRAQNFRIDTRSGRITTARPLDREEQANYRLTILASSSSSSSAAASSVSYGQCIVNIAIIDLNDNAPVFALDRESEPTISLPENAAVGQEIYLSRVRDRDAGVNSRISYSLTNNPNQQFRIGPVTGVLYLQRPIRAEPGSLIHVELMATDAGSPPLSSKLSLSVLIADVNDHTPVFDHTSYETSLPETTKVNTRFFALAATDIDLGDNGRISYEIIEGNTERMFGVFPDGYLFVRAPLDREERDYYALTVSCRDAGQPSRSSVVPVVIHVIDENDNAPQFTNSTFTFSIPENAPADTFVGKLTAVDRDIGRNAELSFTLSSQTQDFTIDTRNGFIKTLRPFDREALVKVSRNAEASGEDGSLRGSMAGNYMLLEATVSDNGIPRLQDKVKVKVIVTDVNDNAPEFLRAPYHVTISEGASEGTHITHVFTQDADEGLNGDVYYSLAKGNEAGQFNLDSATGQLSLGRRLDRESQEIHHLIVVAKDAALKHPLSSNASITIVVLDENDNAPEFTQSSSEVSVLETSPTGTELMRFRASDADQGVNSQVVFSISAGNRRDTFHIDSITGSLYLHKPLDYEDITSYTLNITASDCGTPSLSTTVLYNVLVVDDNDNPPIFPSTAIVRQIKEGIPLKTPIVTVTADDPDSGLNGKVSYAISKQEPQLPQGRHFGINTETGVIHTLREIDRESIDTFRLTVVATDRAQPSERQLSTEKLVTVIVEDINDNAPVFVSMNAAILPPKFSTSKGSSTAVMQVHAKDADSSSNGLVTYEIVSGPQELFKLQRNTGIITFTPGPQFKQEVRYQLTLKSTDEAVQSERRSSEVYITIITPGSGGSESSVPQFEQRSKLSGSVYENEPIGTSILTVTAHLASAEIEYFVTNVTATGSRGQVDRLFDIDAKLGILSTAAELDREAGPEEYEVEVYAIALGGQPRTSRTKVRVTVLDKNDSPPQFLDTPFVYNVSEDLQIGHTISTLRAHDPDTLGSVTFLLMDGHDGKFLLEPSTGKLILNDTLDRETKSKYELRIRVSDGVQYTEAYATIQVSDTNDNPPLFEDTVYSFDIPENAQRGYQVGQIVARDADLGQNAQLSYGVVSDWANDVFSLNPQTGMLTLTARLDYEEVQHYILIVQAQDNGQPSLSTTITVYCNVLDLNDNAPIFDPMSYSSEVFENVPIATEVVTVSAKDIDSGNNGLIEYSITAGDVDSEFGIDSNGTIRTRRNLDREHRSTYTLTVTARDCADEFASFSELEETQLKLKYRSPRKYQQTRQEFLAHQKQQRLSSTVKVTILIKDVNDEVPVFISANETAIMENVAINTVVIAVKAVDNDEGRNGYIDYLMKEARDEDMGQSDPLPFSLNPTDGQLRVVDALDRELRSSYLLNITARDRGEPPQSTESQLLIRILDENDNSPVFDPKQYSASVAENASIGAMVLQVSATDVDEGANGRIRYSIVLGDQNHDFSISEDTGVVRVAKNLNYERLSRYSLTVRAEDCALENPAGDTAELTINILDINDNRPTFLDSPYLARVMENTVPPNGGYVLTVNAYDADTPPLNSQVRYFLKEGDSDLFRINASSGDIALLKPLDREQQSEYTLTLVAMDTGSPPLTGTGIVRVEVQDINDNDPVFELQSYHATVRENLPSGTHVLTPRATDKDEGLNAKLRFNLLGEHMHRFHIDSETGEISTATTLDREETSVYHLTLMAQDSSITEPRASSVNLTISVSDVNDNIPKFDSTTYNVAVPERISKGEFVFGARALDLDDGENAVVHYTISGRDQHYFDINTKTGVVSTKLELKTKTKSHDDLTYTIVISAMDQGEQSLSSKAELTVILRPPELFPTFAYMANSHFAMSEDVRPGKMITKVSATSPKKGLVGKIRYAIAGGIMGDSLRVDPNSGLLSVGQDGLDYELTHLYEIWIEAADGDTPSLRSVTLITLNVTDANDNAPVMEQLIYNAEVLEEESPPQLIAVVKASDRDSGDNGNVIYRLQNDFDGTFEITESGEIYTRMRLDREEIGDYAFVVEAVDQGVPHMTGTASVLLHLLDKNDNPPKFTRLFSLNVTENAEIGSFVIRVTSSDLDLGANANASYSFSENPGEKFRIEPQSGNITVAGHLDREQQDEYILKVVASDGAWRAETPITITIQDQNDNAPEFEHSFYSFSFPELQQSIALVGQIIATDRDKQGPNSVISYSLQQPSPMFSIDPATGEVFSKKAVRFKHSQYVRSPENMYALTVLATDNGKPPLYSECLVNINIVDAHNNPPKFEQAEYLAPLPQDAVRGQRIVRVHANDKQDLGTNEMDYSLMTFNLSSIFSVGRHDGWITLVKPIQVPPNTRYELVVRATDRGVPPQSDETRVVIVVTGENMDTPRFSVNSYQVIVPENEPVGSTILTVGATDDDTGPNGMLRYSISGGNERQDFSVDERTGGIVIQQQLDYDLIQEYHLNITVQDLGYHPLSSVAMLTIILTDVNDNPPVFNHKEYHCYIPENKPVGTFVFQAHAADKDSPKNAIIHYAFLPSGPDRHFFIMNQSNGTISSAVSFDYEERRIYTLQIKAKNPDSSMESYANLYVHVLGVNEFYPQFLQPVFHFDVSETSAVGTRVGAVQATDKDSGEDGRVYYLLVGSSNDKGFRIDTNTGLIYVARHLDRETQNRVVLTVMAKNYGSIRGNDTDEAQVIISIQDGNDPPEFIKHYYTSTISEAAPVGTKVTTVKAIDKDVRTQNNQFSYSIINGNLKQSFKIDVQTGEISTASRLDREETSTYNLVIGAIDTGLPPQTGSATVHIELEDVNDNGPTFTPEGLNGYISENEPAGTSIMTLIASDPDLPRNGGPFTYQLIGGKHKSWLSVDRNSGVVRSTTSFDREMTPILEAIIEVEDSGKPKQKSQHLLTITVLDQNDNPSTTRSLHIAVSLFNGDLPSNVKLADVRPNDIDIVGDYRCRLQKNPAQSQLQLAIPRACDLITTSHTTPIASVFSYTGNDGKHGDVSSKVSVAFQSFNNETLANSVSIMVRNMTAYHFLANHYRPILEMIKSRMSNEDEVILYSLLEGGSGNSTNLQLLMAVRLAKTSYQQPKYLIERLREKRSAFSELLQKEVIVGYEPCSEPDVCENGGVCSATMRLLDAHSFVIQDSPALVLSGPRVVHDYSCQCTSGFSGEQCSRRQDPCLPNPCHSQVQCRRLGSDFQCMCPANRDGKHCEKERSDVCYSKPCRNGGSCQRSPDGSSYFCLCRPGFRGNQCESVSDSCRPNPCLHGGLCVSLKPGYKCNCTPGRYGRHCERFSYGFQPLSYMTFPALDVTTNDISIVFATTKPNSLLLYNYGMQSGGRSDFLAIELVHGRAYFSSGGARTAISTVIAGRNLADGGWHKVTATRNGRVMSLSVAKCADSGDVCTECLPGDSSCYADEVGPVGTLNFNKQPLMIGGLSSADPILERPGQVHSDDLVGCLHSVHIGGRALNLSLPLQQKGILAGCNRQACQPALAAERCGGFAGQCIDRWSSSLCQCGGHLQSPDCSDSLEPITLGEGAFVEFRISEIYRRMQLLDNLYNSKSAWLDNQQMRERRAVSNFSTASQIYEAPKMLSMLFRTYKDQGQILYAATNQMFTSLSLREGRLVYYSKQHLTINMTVQETSTLNDGKWHNVSLFSESRSLRLIVDGRQVGDELDIAGVHDFLDPYLTILNVGGEAFVGCLANVTVNNELQPLNGSGSIFPEVRYHGKIESGCRGDIGQDAAQVADPLSIGFTLVIVFFVILVVAILGSYVIYRFRGKQEKIGSLSCGVPGFKIKHPGGPVTQSQVDHVLVRNLHPSEAPSPPVGAGDHMRPPVGSHHLVGPELLTKKFKEPTAEMPQPQQQQQRPQRPDIIERESPLIREDHHLPIPPLHPLPLEHASSVDMGSEYPEHYDLENASSIAPSDIDIVYHYKGYREAAGLRKYKASVPPVSAYTHHKHQNSGSQQQQQQHRHTAPFVTRNQGGQPPPPPTSASRTHQSTPLARLSPSSELSSQQPRILTLHDISGKPLQSALLATTSSSGGVGKDVHSNSERSLNSPVMSQLSGQSSSASRQKPGVPQQQAQQTSMGLTAEEIERLNGRPRTCSLISTLDAVSSSSEAPRVSSSALHMSLGGDVDAHSSTSTDESGNDSFTCSEIEYDNNSLSGDGKYSTSKSLLDGRSPVSRALSGGETSRNPPTTVVKTPPIPPHAYDGFESSFRGSLSTLVASDDDIANHLSGIYRKANGAASPSATTLGWEYLLNWGPSYENLMGVFKDIAELPDTNGPSQQQQQQTQVVSTLRMPSSNGPAAPEEYVSPPLEMENTALCNTENTCHANGEREGINSHWNANALYZETHISSEQENCERNBLASTIDENTIFYCNSERVEDDMAINSHIGHLIGHTSEQENCEFEATRESFINDINTHISSEQENCESHWINGENMEDATAVIEWERARTICLESABTTHEFTGENELCALCELLDEATHCHANGESTHERIENTATINFCELLDIVISININTHEDEVELPINGDRSPHILAWINGIMAGINALDISCWITHTSINGFATRDACHSSASRIENTINGSIGNALSPLSNECLLECTIVEPLARIZATINMDELFRGRADIENTSENSINGVIADACHSSFATINTERCELLLARSIGNALINGPRCNATLACADSCISASTRCTRALANDFNCTINALCHARACTERIZATINFTHEDRSPHILAGLYCGENPHSPHRYLASEGENEBICHEMBIPHYSRESCMMNSEEALLPATHWAYSFRTHEFTGENEHIPPSIGNALINGPATHWAYMLTIPLESPECIESHIPPSIGNALINGPATHWAYFLYREFERENCESEQENCEINFRMATINREFSEQMRNASEEREFERENCEMRNASEQENCEFRTHEFTGENENMMREABTTHEFTGENEFTGENEALSKNWNASDMELCGCGHMLGSFTHEFTGENETHEFTGENEISCNSERVEDINHMANCHIMPANZEERHESSMNKEYDGCWMSECHICKENZEBRAFISHMSQITANDFRGRELATEDINFRMATINSIMILARPRTEINSEQENCESSINGSMARTBLASTBIPRECTNCLETIDEPBMEDTAXNMYRELATEDSEQENCESBISYSTEMSCDDSEARCHRESLTSCNSERVEDDMAINSCNCISECNSERVEDDMAINSFLLDMAINRELATIVESENCDINGMRNAFLLTEXTINPMCGENEGENEVIEWINDBSNPGENMEHMLGENEMAPVIEWERPRTEINNIPRTKBPRTEINSWITHSIMILARSEQENCESPBMEDREFSEQPBMEDWEIGHTEDRELATEDSTRCTRESLISTRELATEDSTRCTRESSMMARYNIGENEBLINKDEPRECATEDLINKTTEXTERNALRESRCESENSEMBLENSEMBLMDBASEDATABASEFCMPARATIVEPRTEINSTRCTREMDELSSALILABCSFMDBASEDATABASEFCMPARATTRANSCRIPTPRTEININFRMATINPANTHERCLASSIFICATINSYSTEMPRTEINNTLGYCNSRTIMPRTEINNTLGYCNSRTIMRECENTACTIVITYCLEARTRNFFAPPGENENAMEPRTEINAPPPRTEINAPPALLFIELDSPRTEINFLAMINGDRSPHILAMELANGASTERPRTEINECADTSSYNTHETICCNSTRCTPRTEINSEEMREYAREHERENCBIPRTEINSPRTEINDATABASESPPRTCENTER

SEQ ID NO: 259 - protein, 211 aa, Artificial sequence
  synthetic amino acid sequence
DNQQMRERRAVSNFSTASQIYEAPKMLSMLFRTYKDQGQILYAATNQMFTSLSLREGRLVYYSKQHLTINMTVQETSTLNDGKWHNVSLFSESRSLRLIVDGRQVGDELDIAGVHDFLDPYLTILNVGGEAFVGCLANVTVNNELQPLNGSGSIFPEVRYHGKIESGCRGDIGQDAAQVADPLSIGFTLVIVFFVILVVAILGSYVIYRFR

SEQ ID NO: 260 - protein, 2647 aa, Homo sapiens
MSSSHSRAGQSAAGAAPGGGVDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVTNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPMGQKGTVEPQLEARGDSTYRCSYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPMVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFLPREEGPYEVEVTYDGVPVPGSPFPLEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGMYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPSVQPPLRSQQLAPQYTYAQGGQQTWAPERPLVGVNGLDVTSLRPFDLVIPFTIKKGEITGEVRMPSGKVAQPTITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHVPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGNPAEFVVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADASKVVAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 261 - protein, 370 aa, Artificial sequence
  synthetic amino acid sequence
MACKMQIFVKTLTGKTITLEVEPSDTIENVKAKIQDKEGIPPDQQRLIFAGKQLEDGRTLSDYNIQKESTLHLVLRLRGGELGGSGGSGEGRVKESITRRRRAPSVANVGSHSDLSLKIPEISIQDMTAQVTSPSGKTHEAEIVEGENHTYSIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSSGVAYVVQEPGDYEVSVKFNEEHIPDSPFVVPVASPSSGGSGGTMQIFVKTLTGKTITLEVEPSDTIENVKAKIQDKEGIPPDQQRLIFAGKQLEDGRTLSDYNIQKESTLHLVLRLRGGKCLER

SEQ ID NO: 262 - protein, 293 aa, Artificial sequence
  synthetic amino acid sequence
MACKMQIFVKTLTGKTITLEVEPSDTIENVKAKIQDKEGIPPDQQRLIFAGKQLEDGRTLSDYNIQKESTLHLVLRLRGGELGGSGGPTFRSSLFLWVRPGGSGGSGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSSGGSGGTMQIFVKTLTGKTITLEVEPSDTIENVKAKIQDKEGIPPDQQRLIFAGKQLEDGRTLSDYNIQKESTLHLVLRLRGGKCLER

SEQ ID NO: 263 - protein, 2033 aa, Artificial sequence
  synthetic amino acid sequence
MSTSVQRMSRSYHCINMSATPQAGHLNPAQQQTHQQHKRKCRDLGRRLIPARLLLGVIVAISLLSPALALHSPPDKNFSGDNRKPAFKNCAGYAPKVKEEQPENTYVLTVEAVDPDPDQVIRYSIVQSPFERPKFFINPSTGVIFTTHTFDRDEPIHEKFVFVTVQATDNGLPPLDDVCTFNVTIEDINDNAPAFNKARYDESMSENAQPDAVVMTISASDFDDGNNSLVEYEILRERDFQYFKIDKESGIIYLKRPIDKRPGQSYAIIVRAYNVVPDPPQDAQIEVRIRVVESSIKPPSFVNPIDTPIYLKENLKNFTHPIATLRAVSNMPDKPEVIFELNTGRTEQTNSKNTFVFNQIGNEVTISLGKTLDYEAITDYTLTMIVRNTHELGTEHQIKIQVEDVNDNIPYYTEVKSGTILENEPPGTPVMQVRAFDMDGTSANNIVSFELADNREYFTIDPNTGNITALTTFDREERDFYNVKVIASDNSPSSLFDNGEPNRGHQVFRISIGDKNDHKPHFQQDKYLAERLLEDANTNTEVIEVKAEDEDNASQILYSIESGNVGDAFKIGLKTGKITVNQKLDYETITEYELKVRAFDGIYDDYTTVVIKIEDVNDNPPVFKQDYSVTILEETTYDDCILTVEAYDPDIKDRNADQHIVYSIHQNDGNRWTIDNSGCLRLVKTLDRDPPNGHKNWQVLIKANDEDGVGTTVSTVKEVTVTLKDINDNAPFLINEMPVYWQENRNPGHVVQLQANDYDDTPGAGNFTFGIDSEATPDIKTKFSMDGDYLHANVQFDREAQKEYFIPIRISDSGVPRQSAVSILHLVIGDVNDNAMSEGSSRIFIYNYKGEAPETDIGRVFVDDLDDWDLEDKYFEWKDLPHDQFRLNPSTGMITMLVHTAEGEYDLSFVVTEDSMFVPRHSVDAYVTVVVRELPEEAVDKSGSIRFINVTKEEFISVPRDFQSPDALSLKDRFQLSLAKLFNTSVSNVDVFTVLQNENHTLDVRFSAHGSPYYAPEKLNGIVAQNQQRLENELDLQMLMVNIDECLIEKFKCEESCTNELHKSSVPYMIYSNTTSFVGVNAFVQAQCVCEAPLMRRCLNGGSPRYGENDVCDCIDGFTGPHCELVSVAFYGSGYAFYEPIAACNNTKISLEITPQIDQGLIMYLGPLNFNPLLAISDFLALELDNGYPVLTVDYGSGAIRIRHQHIKMVADRTYQLDIILQRTSIEMTVDNCRLSTCQTLGAPIGPNEFLNVNAPLQLGGTPVDLEQLGRQLNWTHVPNQKGFFGCIRNLTINEQTYNLGMPSVFRNIDSGCQQSVAVAFSFGIDRNFIIAIIVCLALLLIILLAVVVQKKQKNGWHEKDIDDIRETIGTSVVEFMVSKGEETTMGVIKPDMKIKLKMEGNVNGHAFVIEGEGEGKPYDGTNTINLEVKEGAPLPFSYDILTTAFAYGNRAFTKYPDDIPNYFKQSFPEGYSWERTMTFEDKGIVKVKSDISMEEDSFIYEIHLKGENFPPNGPVMQKKTTGWDASTERMYVRDGVLKGDVKHKLLLEGGGHHRVDFKTIYRAKKAVKLPDYHFVDHRIEILNHDKDYNKVTVYESAVARNSTDGMDELYKGPGGAGPGGAGPGGAGPGGAGPGGAGPGGAGPGGAGPGGAMVSKGEELFTGVVPILVELDGDVNGHKFSVSGEGEGDATYGKLTLKLICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYKYAAAINYEDEGGGERDTDYDLNVLRTQPFYEEKLYKDPHALQGNMRDPNDIPDIADFLGDKKENCDRDVGATTVDDVRHYAYEGDGNSDGSLSSLASCTDDGDLNFDYLSNFGPRFRKLADMYGEEPSDTDSNVDDDQGWRI

SEQ ID NO: 264 - protein, 515 aa, Artificial sequence
  synthetic amino acid sequence
MVSKGEETTMGVIKPDMKIKLKMEGNVNGHAFVIEGEGEGKPYDGTNTINLEVKEGAPLPFSYDILTTAFAYGNRAFTKYPDDIPNYFKQSFPEGYSWERTMTFEDKGIVKVKSDISMEEDSFIYEIHLKGENFPPNGPVMQKKTTGWDASTERMYVRDGVLKGDVKHKLLLEGGGHHRVDFKTIYRAKKAVKLPDYHFVDHRIEILNHDKDYNKVTVYESAVARNSTDGMDELYKGPGGAGPGGAGPGGAGPGGAGPGGAGPGGAGPGGAGPGGAMVSKGEELFTGVVPILVELDGDVNGHKFSVSGEGEGDATYGKLTLKLICTTGKLPVPWPTLVTTLGYGLQCFARYPDHMKQHDFFKSAMPEGYVQERTIFFKDDGNYKTRAEVKFEGDTLVNRIELKGIDFKEDGNILGHKLEYNYNSHNVYITADKQKNGIKANFKIRHNIEDGGVQLADHYQQNTPIGDGPVLLPDNHYLSYQSKLSKDPNEKRDHMVLLEFVTAAGITLGMDELYK

SEQ ID NO: 265 - protein, 398 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 266 - protein, 328 aa, Artificial sequence
  synthetic amino acid sequence
AARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSGR

SEQ ID NO: 267 - protein, 254 aa, Mus musculus
MANLGYWLLALFVTMWTDVGLCKKRPKPGGWNTGGSRYPGQGSPGGNRYPPQGGTWGQPHGGGWGQPHGGSWGQPHGGSWGQPHGGGWGQGGGTHNQWNKPSKPKTNLKHVAGAAAAGAVVGGLGGYMLGSAMSRPMIHFGNDWEDRYYRENMYRYPNQVYYRPVDQYSNQNNFVHDCVNITIKQHTVTTTTKGENFTETDVKMMERVVEQMCVTQYQKESQAYYDGRRSSSTVLFSSPPVILLISFLIFLIVG

SEQ ID NO: 268 - protein, 232 aa, Artificial sequence
  synthetic amino acid sequence
KRPKPGGWNTGGSRYPGQGSPGGNRYPPQGGTWGQPHGGGWGQPHGGSWGQPHGGSWGQPHGGGWGQGGGTHNQWNKPSKPKTNLKHVAGAAAAGAVVGGLGGYMLGSAMSRPMIHFGNDWEDRYYRENMYRYPNQVYYRPVDQYSNQNNFVHDCVNITIKQHTVTTTTKGENFTETDVKMMERVVEQMCVTQYQKESQAYYDGRRSSSTVLFSSPPVILLISFLIFLIVGR

SEQ ID NO: 269 - protein, 483 aa, Homo sapiens
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSER

SEQ ID NO: 270 - protein, 41 aa, Artificial sequence
  synthetic amino acid sequence
GDRCQNYVMASFYKHLGIEFMEAEELYQKRVLTITGICIAR

SEQ ID NO: 271 - protein, 3575 aa, Drosophila melanogaster
MQTREFPQRPLGLLLVLLVVLLQSSLIKSYLIIVHEDTPPGTVIFNASVYKLGSERHYKINAHKSANFVHHLVSVNHKDGQIQLRKALKCDGIYYPNLFTFYVDSTSNRLRSIDYYSLPVRIFVSGHSCNEDRRIEQELHHHHYEEEDNTGYSKRRRRRSTQEMIQLNGNQLEEVFRQNSTEFRAGDLIFGDSFDNEMRHRILSRKRRAVGSPDPLHLQPALHRRISDAKQWISETYASYAIHTTDKWNQICLRRSQFINSLNAFLPRSVCQHCKVSFLDVNDERFAIEHQSRDLVASRDVCIAESMWKVSITFNIRCDRRDIVDSDHRLKIVYHHQEFNDTDIARRVRRELRNQSPYFEQALYVASVLEEQPAGAAVTTVRARDPEDSPVVYSNGLTVGLPRSQSLFKVDSRTGVVTTSASLDRELMDVHYFRVVATDDSFPPRSGTTTLQVNVLDCNDHSPTFEAEQFEASIREGATVGSTVITLRATDQDIGKNAEIEYGIEAVTDGAGLAQDQEMPIFRIDSRSGVISTRSSLDRETSDSYHLLVTAADLASAQSERRTATASVQVKVLDDNDNYPQFSERTYTVQVPEDQWGGTEDNTVAHIRATDADQGNNAAIRYAIIGGNTQSQFSIDSMSGDVSLVKPLDYESVRSYRLVIRAQDGGSPSRSNTTQLLVNVIDANDNAPRFYTSQFQESVLENVPVGYNIIRVQAYDSDEGANAEITYSISERDDNFPLAVDPRTGWVQTIKPLDREEQGRFAFQVVAKDGGVPPKSASSSVVITVQDVNDNDPAFNPKYYEANVGEDQPPGTPVTTVTATDPDEDSRLHYEITTGNTRGRFAITSQNGRGLITIAQSLDYKQEKRFLLTVAATDSGGRSDTATVHINITDANNFAPIFENAPYSASVFEDAPVGTTVLVVSATDSDVGVNAQITYSLNEESINGLGSPDPFSINPQTGAIVTNAPLDRETTSGYLLTVTAKDGGNPSLSDTTDVEIGVTDVNDNAPAFKSPLYQASILEDALVGTSVIQVAASDPDVGLNGRIKYLLSDRDIEDGSFVIDPTSGTIRTNKGLDRESVAVFHLTAIAVDKGSPPLSSTVEVQIRLEDVNDSPPTFASDKITLYVPENSPVGSVVGEIHAHDPDEGVNAVVHYSIIGGDDSNAFSLVTRPGSERAQLLTMTELDYESTRKRFELVVRAASPPLRNDAHIEILVTDVNDNAPVLRDFQVIFNNFRDHFPSGEIGRIPAFDADVSDKLHYRILSGNNANLLRLNSSSGGLVLSPQLNTNVPKFATMEVSVSDGINEAKAIMQLSVRLITEDMLFNSVTVRLNEMTEEAFLSPLLNFFLDGLAAIIPCPKEHIFVFSIQDDTDVSSRILNVSFSARRPDVSHEEFYTPQYLQERVYLNRAILARLATVEVLPFDDNLCVREPCLNFEECLTVLKFGNASEFIHSDTVLFRPIYPVNTFACSCPEGFTGSKEHYLCDTEVDLCYSDPCQNGGTCVRREGGYTCVCPSTHTGQNCETGVGHLRPCPSETCEGGLSCLSNYPSSQPPPYTATCELRARAFGRNSFLTFESLKQRHRFNLKLRFATVQENGLLLYNGRYNELHDFIALEIHEGHVSFSFSLGDHSERISVIQEAKVSDGKWHQVEVVYLNRSVTLVLDNCDTAIALSGQLGDRWSCANRTTLKLDKRCSLLTETCHRFLDLTGPLQVGGLPRIPAHFPVTNRDFVGCISDLRIDDRFVDLNSYVADNGTLAGCPQKAPLCQSEPCFNGGTCREGWGTYSCECPEGYAGNSCQDNIPAPWRFSGDGSLSFNPLLRPIQLPWTTSFSLRTRQKEAFLLQIQIGQNSSAAVCLRQGVLYYIFDGEPMYLAGAFLSDGEWHRVEIRWQQGSEIHFSVDYGQRSGSVPMSQKVQGLYVGKIVMGSPDGSIGAVPEASPFEGCIQDVRIGAGQSVLSRPTIRENVEDGCESRAQCPDHCPNHSSCQSSWDLSTCECDSGYVGTDCAPICTVRPCASGVCRANTSLPRGYDCECNSSSRHGDYCEKELQQPCPGGWWGERVCGPCRCDLAQGYHPDCNKTTGQCYCKTNHYQPPNETACLSCDCYSIGSFSGACNPLTGQCECREGVIGRRCDSCSNPYAEVTLSGCEVVYDACPRSFAGGVWWPRTPLGGVAIEGCPPPARGKGQRSCDVQSGSWNTPDMYNCTSEPFVELRRQLSQLEKLELELNSFVAIKMAEQLRKACEAVDRRGASKDQKISGNGRPNRRYKMESSFLLSNGGNVWSHELEMDYLSDELKFTHDRLYGADLLVTEGLLQELINYELMQSGLNLSHSQDKYFIKNLVDAASVILDRKYEAEWRRATELIQRGPDDLVDAFNKYLVVLARSQHDTYTSPFEIVQPNMALGLDIVTTESLFGYEPEQLSEYHRSKYLKPNAFTTESVVLPDTSGFLQHSARQRPVISFPKYNNYILDRRKFDQHTKVLVPLEMLGITPPESDEISQSGRRGSSHDHCAIVAYAQYKDVGQLLPDLYDETITRRWGVDVELATPILSLQILVPSMEREQETQRLEIPSRKIFSSSSPSSSSSSGSTEQQFVEVFDVPKAPTSSSEQQIEDIRITAHEIPPPVSSVEQQEASSGEDGEEREPHIRLNLDDIEFHGNSGEEVISPDSPEMLNPNYEGVSSTGSDEQPKGENEAVYRDRRLVKRQVEITYPSEQMQQSEQVVYRSLGSPHLAQPIKLQMWLDVDSARFGPRSNPQCVRWNSFTNRWTRLGCQTEIPDFDGDFNPAAQQAILVNCSCTHISSYAVIVDVIDPEDIPEPSLLVQITSYSAFLVSLPLLLGVLLALALLRGQQTNSNTIHQNIVLCVFCAELLFFVGMQSRRQLLESEFPCKLTAICLHYFWLAAFAWTTVDCVHLYRMLTEMRDINHGPMGFYFAMGYGAPAIVVGLSVGVRAHEYGNSLFCWLSVYEPVVWWLVGPIAGMSVVNLLILFVSVKAAFTLKDHVLGFGNLRTLLWLSVVSLPLMGVMWVLAVLAASEHSQLLSLLLSGVVLLHALFCLIGYCIINKRVRENLQRTCLRCMGRKVPLLDSSMVVSNSSHNVNAAARPSNFLASGYDTTTRRNIGISASSTTSRSTAKTSSSPYSDGQLRQTSTSTSNYNSASDAPSFLRGFESSTTGRSRGGEEKPSRRQRKDSDSGSETDGRSLELASSHSSDDDESRTARSSGTHRSTAVSSTPAYLPNITEHVQATTPPELNVVQSPQLFPSVNKPVYAPRWSSQLPDAYLQSPPNIGRWSQDTGSDNEHVHGQAKMTISPNPLPNPDLTDTSYLQQHHNKINMPPSILENIRDAREGYEDSLYGRRGEYPDKYGSYKPPSHYGSEKDYPGGGSGSQTIGHMRSFHPDAAYLSDNIYDKQRTLGSGYLGAKSESPYLSKDRITPDIYGSRDGHYSLKRQPAYATDSLHSVHSLLKNDYHQQQQQQQQHHLQDRLSEGSDKNGYHFPYTAEEDHLPARKLSHTQPPSLHGSQLMQPPGVGLVNDVNNPGLMGRHTLNGGSRHSSRASSPPSTMVAPMQPLGPLTSITDTDSEAEY

SEQ ID NO: 272 - protein, 73 aa, Artificial sequence
  synthetic amino acid sequence
PRNPQCVRWNSFTNRWTRLGCQTEIPDFDGDFNPAAQQAILVNCSCTHISSYAVIVDVIDPEDIPEPSLLVQR

SEQ ID NO: 273 - protein, 116 aa, Artificial sequence
  synthetic amino acid sequence
ITYPSEQMQQSEQVVYRSLGSPHLAQPIKLQMWLDVDSARFGPRSNPQCVRWNSFTNRWTRLGCQTEIPDFDGDFNPAAQQAILVNCSCTHISSYAVIVDVIDPEDIPEPSLLVQR

SEQ ID NO: 274 - protein, 44 aa, Artificial sequence
  synthetic amino acid sequence
PRGPGGAGPGGAGPGGAGPGGAGPGGAGPGGAGPGGAGPGGARR

SEQ ID NO: 275 - protein, 8 aa, Artificial sequence
  synthetic amino acid sequence
PPANVKYV

SEQ ID NO: 276 - protein, 770 aa, Homo sapiens
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 277 - protein, 770 aa, Mus musculus
MLPSLALLLLAAWTVRALEVPTDGNAGLLAEPQIAMFCGKLNMHMNVQNGKWESDPSGTKTCIGTKEGILQYCQEVYPELQITNVVEANQPVTIQNWCKRGRKQCKTHTHIVIPYRCLVGEFVSDALLVPDKCKFLHQERMDVCETHLHWHTVAKETCSEKSTNLHDYGMLLPCGIDKFRGVEFVCCPLAEESDSVDSADAEEDDSDVWWGGADTDYADGGEDKVVEVAEEEEVADVEEEEADDDEDVEDGDEVEEEAEEPYEEATERTTSTATTTTTTTESVEEVVREVCSEQAETGPCRAMISRWYFDVTEGKCVPFFYGGCGGNRNNFDTEEYCMAVCGSVSTQSLLKTTSEPLPQDPDKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPHHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHPFGVDSVPANTENEVEPVDARPAADRGLTTRPGSGLTNIKTEEISEVKMDAEFGHDSGFEVRHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 278 - protein, 770 aa, Rattus norvegicus
MLPSLALLLLAAWTVRALEVPTDGNAGLLAEPQIAMFCGKLNMHMNVQNGKWESDPSGTKTCIGTKEGILQYCQEVYPELQITNVVEANQPVTIQNWCKRGRKQCKTHTHIVIPYRCLVGEFVSDALLVPDKCKFLHQERMDVCETHLHWHTVAKETCSEKSTNLHDYGMLLPCGIDKFRGVEFVCCPLAEESDSIDSADAEEDDSDVWWGGADTDYADGGEDKVVEVAEEEEVADVEEEEAEDDEDVEDGDEVEEEAEEPYEEATERTTSIATTTTTTTESVEEVVREVCSEQAETGPCRAMISRWYFDVTEGKCAPFFYGGCGGNRNNFDTEEYCMAVCGSVSSQSLLKTTSEPLPQDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPHHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHPFGVDSVPANTENEVEPVDARPAADRGLTTRPGSGLTNIKTEEISEVKMDAEFGHDSGFEVRHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 279 - protein, 770 aa, Sus scrofa
MLPGLALVLLAAWTARALEVPTDGNAGLLAEPQVAMFCGKLNMHMNVQNGKWESDPSGTKTCIGTKEGILQYCQEVYPELQITNVVEANQPVTIQNWCKRSRKQCKTHTHIVIPYRCLVGEFVSDALLVPDKCKFLHQERMDVCETHLHWHTVAKETCSEKSTNLHDYGMLLPCGIDKFRGVEFVCCPLAEESDNIDSADAEEDDSDVWWGGADTDYADGSEDKVVEVAEEEEVADVEEEEAEDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSVMSQSLLKTTQEHLPQDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHPFGVDSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 280 - protein, 770 aa, Pan troglodytes
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSVMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 281 - protein, 770 aa, Cavia porcellus
MLPSLALLLLTTWTARALEVPTDGNAGLLAEPQIAMFCGKLNMHMNVQNGKWEPDPSGTKTCIGSKEGILQYCQEVYPELQITNVVEANQPVTIQNWCKRSRKQCKTHPHFVIPYRCLVGEFVSDALLVPDKCKFLHQERMDVCETHLHWHTVAKETCSEKSTNLHDYGMLLPCGIDKFRGVEFVCCPLAEESDNIDSADAEEDDSDVWWGGADTDYADGSEDKVVEVAEEEEVADVEEEEADDDEDVEDGDEVEEEAEEPYEEATEKTTSIATTTTTTTESVEEVVREVCSEQAETGPCRSMISRWYFDVTEGKCAPFFYGGCGGNRNNFDTEEYCMAVCGSVMSQNLLKTSGEPVSQGPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHPFGVDSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 282 - protein, 751 aa, Saimiri sciureus
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRDRKQCKTHPHIVIPYRCLVGEFVSDALLVPDKCKFLHQERMDVCETHLHWHTVAKETCSEKSTNLHDYGMLLPCGIDKFRGVEFVCCPLAEESDHVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSVIPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 283 - protein, 770 aa, Macaca fascicularis
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSVMSQSLRKTTREPLTRDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 284 - protein, 737 aa, Takifugu rubripes
MGETTAFVLLLVATLTRSSEIPADDTVGLLTEPQVAMFCGKLNMHINVQNGKWESDPSGTKSCLNTKEGILQYCQEVYPELQITNVVEANQPVSIQNWCKKGRKQCRSHTHIVVPYRCLVGEFVSDALLVPDKCKFLHQERMNQCESHLHWHTVAKESCGDRSMNLHDYGMLLPCGIDRFRGVKFVCCPAETEQETDSSEVEGEESDVWWGGADPEYSENSPPTPSRATYVAGDAFERDENGDGDEDEEDDEDVDPTDEQESDERTANVAMTTTTTTTTESVEEVVRAVCWAQAESGPCRAMLERWYFNPKKRRCVPFLFGGCGGNRNNFESEEYCLAVCSSSLPTVAPSPPDAVDQYFEAPGDDNEHADFRKAKESLEAKHRERMSQVMREWEEAERQAKNLPRADKKAVIQHFQEKVEALEQEAAGERQQLVETHMARVEALLNSRRRLTLENYLGALQANPPRARQVLSLLKKYVRAEQKDRQHTLKHYEHVRTVDPKKAAQIRPQVLTHLRVIDERMNQSLALLYKVPSVASEIQNQIYPAAGSDCKDPVEHCVCPQVDGLVSYGNDALMPDQAYSSAPMDMGVDGLGSIDQSFNQANTENHVEPVDARPIPDRGLPTRPVSSLKLEEMPEVRTETDKRQSAGYEVYHQKLVFFADDVGSNKGAIIGLMVGGVVIATVIVITLVMLRKKQYTSIHHGVIEVDAAVTPEERHLARMQQNGYENPTYKFFEQMQN

SEQ ID NO: 285 - protein, 749 aa, Xenopus laevis
MLPHITLLVLTAGALALEVPADGNGGLLAEPQIAMFCGKLNMHMNVQNGKWETDVSGTKGCIGTKEGILQYCQEVYPELQITNVVEANQPVTIQNWCKKGRKQCKSRTHIVVPYRCLVGEFVSDALLVPDKCKFLHQERMDICETHLHWHTVAKESCSEKSMSLHEYGMLLPCGIDKFRGVEFVCCPSAEESESFDSADAEDDSDVWWGGADADYVDRSDDKAVEAQPDEEEEVVEVEEEETDDDEDDGDEAEEEPEEPYEEATERTTSIATTTTTTTESVEEVVREVCSEQAETGPCRAMISRWYYDVTESKCAQFIYGGCGGNRNNFESDDYCMAVCGSVIPATAASTPDAVDKYLENPNDENEHDRFLKAKERLEGKHREKMSEVMKEWEEAERQAKNLPKADKKAVIQHFQEKVESLEQEAANERQQLVETHMARVEAMLNDRRRIALENYITALQADPPRPRHVFNMLKKYVRAEQKDRQHTLKHFEHVRMVDPKKAAQIRSQVMTHLRVINERMNQSFSLLYKVPAVAEEIQDEVDELFQKEQNYSDDMVSNMVSDHRVSYGNDALMPSLSETKTTVELLPVDGEFNIEDLQPWHSFGVDSVPANTENEVEPVDARPAADRGLTTRPGSGLTNIKTEEISEVKMDSEYRHDTAYEVHHQKLVFFAEEVGSNKGAIIGLMVGGVVIATVIVITLVMLKKKQYTTIHHGVVEVDAAVTPEERHLTKMQQNGYENPTYKFFEQMQN

SEQ ID NO: 286 - protein, 780 aa, Tetraodon fluviatilis
MGHSVAWLLLVAAASTLAAEVPTDVSMGLLAEPQVAMFCGKINMHINVQSGKWEPDPSGTKSCIGTKEGILQYCQEVYPELQITNVVEANQPVSIQNWCKKGRKQCRSHMHIVVPYRCLVGEFVSDALLVPDKCKFLHQERMNQCESHLHWHTVAKESCGDRAMNLHDYGMLLPCGIDRFRGVEFVCCPAEAERDMDSTEKDADDSDVWWGGADNDYSDNSMVREPEPAEQQEETRPSVVEEEEEGEVAQEDDEEEEEVLDTDQDGDGEEDHEAADDEEEEEDVDEIDAFGESDDVDADEPTTNVAMTTTTTTTTTESVEEVVRMFCWAHADTGPCTASMPSWYFDAVDGRTMYELMYGGCGGNMNNFESEEYCLSVCSSVVPTDMPSSPDAVDHYLETPADENEHAHFQKAKESLEAKHRERMSQVMREWEEAERQAKNLPRADKKIVIQRFQEKVEALEQEAASERQQLVETHMARVEALLNDRRRLALENYLTALQQDPPRPRHVFSLLKKYVRAEQKDRQHTLKHFEHVRMVDPKKAAQIRPQVLTHLRVIEERMNQSLGLLYKVPGVADDIQDQVELLQREQAEMAQQLANLQTDVRVSYGNDALMPDQELGDGQADLLPQEDTLGGVGFVHPESFNQLNTENQVEPVDSRPTFERGVPTRPVTGKSMEAVPELRMETEDRQSTEYEVHHQKLVFFAEDVGSNKGAIIGLMVGGVVIATVIVITLVMLRKKQYTSIHHGIIEVDAAVTPEERHLSKMQQNGYENPTYKFFEQMQN

SEQ ID NO: 287 - protein, 254 aa, Homo sapiens; identical to SEQ ID NO: 242

SEQ ID NO: 288 - protein, 233 aa, Homo sapiens
MWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 289 - protein, 254 aa, Macaca mulatta
MWQLLLPTALLLLVSAGMRAEDLPKAVVFLEPQWYRVLEKDSVTLKCQGAYSPEDNSTRWFHNESLISSQTSSYFIAAARVNNSGEYRCQTSLSTLSDPVQLEVHIGWLLLQAPRWVFKEEESIHLRCHSWKNTLLHKVTYLQNGKGRKYFHQNSDFYIPKATLKDSGSYFCRGLIGSKNVSSETVNITITQDLAVSSISSFFPPGYQVSFCLVMVLLFAVDTGLYFSVKKSVPSSTRDWEDHKFKWSKDPQDK

SEQ ID NO: 290 - protein, 249 aa, Rattus norvegicus
MWYLLLPTALLLTVSSGVGAGLQKAVVILDPEWVRVLEEDCVILRCQGTFSPEDNSTKWFHNKSLISHQDANYVIQSARVKDSGMYRCQTAFSALSDPVQLDVHADWLLLQTTKRLFQEGDPIRLRCHSWRNTPVFKVTYLQNGKGKKYFHRNSELSISKATHADSGSYFCRGIIGRNNISSASLQISIGDPTSPSSFLPWHQITFCLLIGLLFAIDTVLYFSVQRSLQSSVAVYEEPKLHWSKEPQDK

SEQ ID NO: 291 - protein, 249 aa, Rattus norvegicus
MWYLLLPTALLLTVSSGVGAGLQKAVVNLDPEWVRVLEEDCVILRCQGTFSPEDNSTKWFHNKSLISHQDANYVIQSARVKDSGMYRCQTAFSALSDPVQLDVHADWLLLQTTKRLFQEGDPIRLRCHSWRNTPVFKVTYLQNGKGKKYFHRNSELSISKATHADSGSYFCRGIIGRNNISSASLQISIGDPTSPSSFLPWHQITFCLLIGLLFAIDTVLYFSVQRSLQSSVAVYEEPKLHWSKEPQDK

SEQ ID NO: 292 - protein, 250 aa, Felis catus
MWRLLSPTALLLLVSAGTRAADLSKAMVVLEPEWNRVLVSDGVILKCEGAYPPGDNSAQWWHNGSVIPHRAPSYSIEAARSEDSGEYKCQTGLSEASDPVQLEVHTGWLLLQAPRWVFQEGDTIQLRCHSWKNKTVQKVQYFQDGRGKMFFHKNSDFYIPKATSKHSGSYFCRGLIGNKNESSEAVNITVQGPPVPSTSTFLPHWYQIAFFLVTALLFVVDTGLHVAVQRDLQSSVKEWKDGKVTWSHGP

SEQ ID NO: 293 - protein, 250 aa, Bos taurus
MWQLLPPAALLLLVSADTQTADPSKAVVLLDPQWNHVLTNDRVTLKCQGDYPVEDNSTKWWHNGTLISSQTPSYFIADVKVQDSGEYKCQTGLSAPSDPVKLEVHVGWLLLQVAQRVVNVGKPIRLKCHSWKKTPVAKVQYFRNGRGKKYSHGNSDFHIPEAKLEHSGSYFCRGIIGSKNESSESVQITVQAPETLQTVSSFFLPWHQITFCLVMGVLFAVDTGLYFSVRRHLQSSEEWRDGKVTWSKGP

SEQ ID NO: 294 - protein, 290 aa, Macaca mulatta
MGGEAGERLFTSSCLVSLVPLGLRISVVTCPLQRGIMWQLLLPTALLLLVSAGMRAEDLPKAVVFLEPQWYRVLEKDSVTLKCQGAYSPEDNSTRWFHNESLISSQTSSYFIAAARVNNSGEYRCQTSLSTLSDPVQLEVHIGWLLLQAPRWVFKEEESIHLRCHSWKNTLLHKVTYLQNGKGRKYFHQNSDFYIPKATLKDSGSYFCRGLIGSKNVSSETVNITITQDLAVSSISSFFPPGYQVSFCLVMVLLFAVDTGLYFSMKKSIPSSTRDWEDHKFKWSKDPQDK

SEQ ID NO: 295 - protein, 250 aa, Ovis aries
MWQLLPPAALLLLVSADTQAADPSKAVVLLDPPWNRVLRNDHVTLKCQGDYPVEDNSTKWWHNGTRISSQTSSYIIADAKVEDSGKYECQTGLSALSDPVKLEVRVDWLLLQATKWVVNVGEPIQLKCHSWKKTPVVKVQYFQNGRGKKYFHRNSDFYIPEAKLEHSGSYFCRGIIGTKNESSESVQIIVQGLGTSQTISSFFPPWHQITFCLVMGLVFAVDTWLYFSVQRHLQNSEEWRNGKVTWSKGP

SEQ ID NO: 296 - protein, 290 aa, Homo sapiens
MGGGAGERLFTSSCLVGLVPLGLRISLVTCPLQCGIMWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 297 - protein, 290 aa, Macaca mulatta
MGGEAGERLFTSSCLVSLVPLGLRISVVTCPLQRGIMWQLLLPTALLLLVSAGMRAEDLPKAVVFLEPQWYRVLEKDSVTLKCQGAYSPEDNSTRWFHNESLISSQTSSYFIAAARVNNSGEYRCQTSLSTLSDPVQLEVHIGWLLLQAPRWVFKEEESIHLRCHSWKNTLLHKVTYLQNGKGRKYFHQNSDFYIPKATLKDSGSYFCRGLIGSKNVSSETVNITITQDLAVSSISSFFPPGYQVSFCLVMVLLFAVDTGLYFSVKKSVPSSTRDWEDHKFKWSKDPQDK

SEQ ID NO: 298 - protein, 258 aa, Dipodomys ordii
MFMPCSSMRRLLPPTVLLLLVSAGVLVGLPKAVVLLDPPWARVLQEDSVTLKCQGTYPPGDNATQWLHNGSLISSQTFSYFIESARVKDSGEYKCQTSLSTLSDPVQLEVHIGWLLLQTTQEVFQEGETIWLKCHSWRNKPVQKVTYLQDGKGMKYFHQNSDFYIPKATRNHSGSYFCRGLIGSKNKSSEAVNIMVQGPGSPTISPVLPWPQITFCLVMGVLFAVDTGLYFSVQRNLQSSMEDRRKHKFQCRLDAQDK

SEQ ID NO: 299 - protein, 259 aa, Dipodomys ordii
MFMPCSSMRRLLPPTVLLLLVSAGVLVAGLPKAVVLLDPPWARVLQEDSVTLKCQGTYPPGDNATQWLHNGSLISSQTFSYFIESARVKDSGEYKCQTSLSTLSDPVQLEVHIGWLLLQTTQEVFQEGETIWLKCHSWRNKPVQKVTYLQDGKGMKYFHQNSDFYIPKATRNHSGSYFCRGLIGSKNKSSEAVNIMVQGPGSPTISPVLPWPQITFCLVMGVLFAVDTGLYFSVQRNLQSSMEDRRKHKFQCRLDAQDK

SEQ ID NO: 300 - protein, 742 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 301 - protein, 778 aa, Mus musculus
MDKFWWHTAWGLCLLQLSLAHQQIDLNVTCRYAGVFHVEKNGRYSISRTEAADLCQAFNSTLPTMDQMKLALSKGFETCRYGFIEGNVVIPRIHPNAICAANHTGVYILVTSNTSHYDTYCFNASAPPEEDCTSVTDLPNSFDGPVTITIVNRDGTRYSKKGEYRTHQEDIDASNIIDDDVSSGSTIEKSTPEGYILHTYLPTEQPTGDQDDSFFIRSTLATIASTVHSKSHAAAQKQNNWIWSWFGNSQSTTQTQEPTTSATTALMTTPETPPKRQEAQNWFSWLFQPSESKSHLHTTTKMPGTESNTNPTGWEPNEENEDETDTYPSFSGSGIDDDEDFISSTIATTPRVSARTEDNQDWTQWKPNHSNPEVLLQTTTRMADIDRISTSAHGENWTPEPQPPFNNHEYQDEEETPHATSTTPNSTAEAAATQQETWFQNGWQGKNPPTPSEDSHVTEGTTASAHNNHPSQRITTQSQEDVSWTDFFDPISHPMGQGHQTESKDTDSSHSTTLQPTAAPNTHLVEDLNRTGPLSVTTPQSHSQNFSTLHGEPEEDENYPTTSILPSSTKSSAKDARRGGSLPTDTTTSVEGYTFQYPDTMENGTLFPVTPAKTEVFGETEVTLATDSNVNVDGSLPGDRDSSKDSRGSSRTVTHGSELAGHSSANQDSGVTTTSGPMRRPQIPEWLIILASLLALALILAVCIAVNSRRRCGQKKKLVINGGNGTVEDRKPSELNGEASKSQEMVHLVNKEPSETPDQCMTADETRNLQSVDMKIGV

SEQ ID NO: 302 - protein, 503 aa, Rattus norvegicus
MDKVWWHTAWGLLCLLQLSLAQQQIDLNITCRYAGVFHVEKNGRYSISRTEAADLCEAFNTTLPTMAQMELALRKGFETCRYGFIEGHVVIPRIHPNAICAANNTGVYILLASNTSHYDTYCFNASAPLEEDCTSVTDLPNSFDGPVTITIVNRDGTRYSKKGEYRTHQEDIDASNIIDEDVSSGSTIEKSTPEGYILHTDLPTSQPTGDRDDAFFIGSTLATIATTPWVSAHTKQNQERTQWNPIHSNPEVLLQTTTRMTDIDRNSTSAHGENWTQEPQPPFNNHEYQDEEETPHATSTTWADPNSTTEEAATQKEKWFENEWQGKNPPTPSEDSHVTEGTTASAHNNHPSQRMTTQSQEDVSWTDFFDPISHPMGQGHQTESKGHSSGNQDSGVTTTSGPARRPQIPEWLIILASLLALALILAVCIAVNSRRRCGQKKKLVINSGNGTVEDRKPSELNGEASKSQEMVHLVNKEPTETPDQFMTADETRNLQSVDMKIGV

SEQ ID NO: 303 - protein, 431 aa, Mesocricetus auratus
MDKFWWHAAWGLCLLPLSLAQQQIDLNITCRYAGVFHVEKNGRYSISRTEAADLCQAFNSTLPTMDQMVMALSKGFETCRYGFIEGHVVIPRIQPNAICAANHTGVYILTSNTSHYDTYCFNASAPLEEDCTSVTDLPNSFEGPVTITIVNRDGTRYSKKGEYRTHQEDIDASNTTDDDVSSGSSSEKSTSGGYVFHTYLPTIHSTADQDDPYFIGSTMATTRSGGKDGRRGGGLPKDATTSLEGYTTHYPETMENGTLTPVTPAKTGVFGETEVTVAEDSNFNVDGSLPGDQDSSMDPRGNSLTVTDGSKLTGHSSGNQDSGANTTSRPGRKPQIPEWLIVLASLLALALILAVCIAVNSRRRCGQKKKLVINSGNGKVEDRKPSELNGEASKSQEMVHLVNKEPSETPDQFMTADETRNLQNVDMKIGV

SEQ ID NO: 304 - protein, 362 aa, Cricetulus griseus
MDKFWWHAAWGLCLLPLSLAHEQIDLNITCRYAGVFHVEKNGRYSISRTEAADLCQAFNSTLPTMDQMVMALSKGFETCRYGFIEGHVVIPRIQPNAICAANHTGVYILTSNTSHYDTYCFNASAPLEEDCTSVTDLPNSFEGPVTITIVNRDGTRYSKKGEYRTHQEDIDASNTTDDDVSSGSSSEKSTSGGYVFHTYLPTIHSTADQDDPYFIGSTMATRDQDSSMDPRGNSLTVTDGSKLTEHSSGNQDSGLNSTSRPGGKPRVPEWLIVLASLLALALILAVCIAVNSRRRCGQKKKLVINSGNGKVEDRKPSELNGEASKSQEMVHLVNKEPSETPDQFMTADETRNLQNVDMKIGV

SEQ ID NO: 305 - protein, 366 aa, Bos taurus
MDTFWWRAAWGLCLVQLSLAQIDLNITCRYAGVFHVEKNGRYSISKTEAADLCKAFNSTLPTMAQMEAARNIGFETCRYGFIEGHVVIPRIHPNSICAANNTGVYILTSNTSQYDTICFNASAPPGEDCTSVTDLPNAFEGPITITIVNRDGTRYTKKGEYRTNPEDINPSVVSPSSPPDDEMSSGSPSERSTSGGYSIFHTHLPTVHPSRPRRPWSQRAENTSDTRDYGSSHDPSGRSYTTHASESAGHSSGSEEHGANTTSGPMRKPQIPEWLIILASLLALALILAVCIAVNSRRRCGQKKKLVINNGNGTMEERKPSGLNGEASKSQEMVHLVNKGSSETPDQFMTADETRNLQNVDMKIGV

SEQ ID NO: 306 - protein, 359 aa, Equus caballus
MDKFWWRAAWGLCLVPLSLAQIDLNITCRYAGVFHVEKNGRYSISRTEAADLCKAFNSTLPTMAQMQKALNIGFETCRIGFIEGHVVIPPIHPNSICAANNTGVYILTSNTSQYDTYCFNASAPPEEDCTSVTDLPNAFEGPITITIVNRDGTRYTKKGEYRTNPEDINPSTPADDDVSSGSSSERSTSGGYSIFHTHLPTTRPTQDQSSPWVSDSPEKTPTTKDRASGGRAQTTHGSETSGHSTGSQEGGASTTSGPIRRPQIPEWLIILASLLALALILAVCIAVNSRRRCGQKKKLVINNGNGAVDDRKASGLNGEASRSQEMVHLVNKESSETQDQFMTADETRNLQNVDMKIGV

SEQ ID NO: 307 - protein, 362 aa, Papio hamadryas
MDKFWWRAAWGLCLVQLSLAQIDLNITCRFEGIYHVEKNGRYSISRTEAADLCKAFNSTLPTMAQMEKALSIGFETCRYGFIEGHVVIPRIHPNSICAANNTGVYILTSNTSQYDTYCFNASAPPGEDCTSVTDLPNAFDGPITITIVNRDGTRYVKKGEYRTNPEDINPSSPTDDDVSSGSSSERSSTLGGYIFYNHFSTSPPIPDEDGPWITDSTDRTPATRDQGAFDPSGGSHTTHGSESAGHSHGSREGGANTTSGPLRTPQIPEWLIILASLLALALILAVCIAVNSRRRCGQKKKLVINNGNGAVEDRKSSGLNGEASKSQEMVHLVNKESSETPDQFMTADETRNLQNVDMKIGV

SEQ ID NO: 308 - protein, 351 aa, Canis lupus familiaris
LAWGLCLLRLSLAQIDLNITCRYAGVFHVEKNGRYSISRTAAADLCKAFNSTLPTMAQMERALSVGFETCRYGFIEGHVVIPRIQPNAICAANHTGVYILISNTSQYDTYCFNASAPPEEDCTSVTHLPNAFDGPITITIVNRDGTRYSQKGEYRTNPEDINPSNPTDDDVSSGSSSERSTSAGYNIFHTHLPTAYPTEDQDSSRVSSNSDHTPITKDHDSSVHPSERSHTTHGSESAGHSSGSQEGGANTTSGPMRKPQIPEWLIILASLLALALILAVCIAVNSRRRCGQKKKLVINNGNGAVGDRKPSGINGEASKSQEMVHLVNKEPSETPDQYTTADETRNLQNVD

SEQ ID NO: 309 - protein, 790 aa, Sus scrofa
MDTFWWRAAWGLCLVQLSLAQIDLNITCRYAGVFHVEKNGRYSISKTEAADLCKAFNSTLPTMAQMEAALNIGFETCRYGFIDGHVVIPRIHPNAICAANNTGVYILASNTSQYDTYCFNASAPPEEDCTSVTDLPNTFEGPITITIVNRDGTRYTKKGEYRTNPEDINPNMAPEDDMSSGSSSERSTSGGYSIFHTHLPTTTHPDQEGPWVSSNPEDTPATTVPSNSHTAAHMPYGRTANNWMWSWFGNSQSKTQDQTTTATTALVSTSGTTSKTATKRHETQDWFSWWFQPSESKNHLHTTTVMAGTDSNIISAGWEPTEDNEDERDKHPSYSGSGIDDDEDFISSTISTTPGVFNHLQQNEDWTQQSPGHLDPEVSLQTTTRMTDMDRSGTSAHGENWTWDPHSSLSHHENHDEEETQHPTSTTQAIPSSTTEETATQKEQWFENGWSGGYPHTPKEDPHATAGITAASAHDSHPSERATTQSQVDSSWTHFFDPVSHPMGRGHQTEERMDEDASHSTTLQPSADPHTGLVEDLDRTGPLSVTAQTEQSDTQSSSTSHGGLEEDKDHPVAATPTSSNRNDGRGGRRGGSLPEDSATSVEGYTLHSPDTNEYRTLILVTPTKTGSPGVTEVTIVGDSTSNVDLSSSEDQDPYFDPSGRSFTTHGSESAGHSSGSQEGEANTTSGPIRKSQIPEWLIILASLLALALILAVCIAVNSRRRIRCGQKKKLVINNGNGPVEERKPSGLNGEASKSQEMVHLVNKESTETPDQFMTADETRNLQNVDMKIGV

SEQ ID NO: 310 - protein, 735 aa, Oryctolagus cuniculus
MDKFWWRAAWGLCLVQLSLAQIDLNITCRYAGVFHVEKNGRYSISRTEAADLCKAFNSSLPTMAQMQKALDQGFETCRYGFIEGHVVIPRIHPNSICAANNTGVYILTSNTSQYDTYCFNASAPLKEDCTAVTDLPKAFDGPITITIVNRDGTRYSKKGEYRTNPEDINPSNSTDDDVSSGSPGERSTFGDYTIFHTHLPTTNPTSDDDIPSDSTPTTITSTVHSNSHAATQEQTNWLWSWFGNSQPKTQDLTTTATSALMSTRGTTFEATTKKPEVQDWLPWWFEPSESKNHLHTTPQAAGTDSNTNSAGWEPNEENEDERDKHFSFPGSGIDDDEDFISSTILITPRISDHTKQNRDWTQWSPSHLNPEVLLQTTTRMTDVERSGSSTQGRSLTQEPEPPLIHPGHHDEEETQHSTSTSSAHNSHPSPKTTTESQWDSSWTDFFDPVSHPMGQDHPAERSMDMDSSLSTMPQPTSDPNTGLVEDLDRTGPLSMTTQQSPLQSFSTLHGGLEEDKDHPTTSLTSRNRTHGRGGRRGENLPADSTTSLQGYTPHYPETKENRTLIPVTPTRTGAFGMTEVAVVGDSNPDVDRSLPGDRGSSIDPSKRSHTTHGSESAGHSSGSQDGGVNTTSGPIRKPQIPEWLIILASLLALALILAVCIAVNSRRRCGQKKKLVINNGNGAVEDRKPSGLNGEASKSQEMVHLVNKESSETPDQCMTADETRNLQNVDMKIGV

SEQ ID NO: 311 - protein, 705 aa, Canis lupus familiaris
MDKLGWHLAWGLCLLRLSLAQIDLNITCRYAGVFHVEKNGRYSISRTEAADLCKAFNSTLPTMAQMERALSVGFETCRYGFIEGHVVIPRIQPNAICAANHTGVYILISNTSQYDTYCFNASAPPEEDCTSVTHLPNAFDGPITITIVNRDGTRYSQKGEYRTNPEDINPSNPTDDDVSSGSSSERSTSAGYNIFHTHLPTAYPTEDQDSSRVSSNSDHTPITSTDSSIISAGWEPTEENEDERDKHPSYSGSGIDDDEDFISSTIPTTPRLFSHPKQNQDWTPWSPGESNPEVLLQTTTRMTDVDRSGTSANGENWTREPHSPLIHHEHHDEEEAQHATSTTEAIPSSTIEETATQKEQWVENGWHGKYPQSPKEDSHSTAGTAAATAQDSHPDQKTTTQSQEDSSWTYFFDPISHPMGPGHQTERWMDMDSSHSPTSQPSADPNTHLVEDLDRIGPLSMTTQQSHTQSFSTSPGGLEEDKNHPTASTPTSKDRTDGRGGREGGHLPEDSAPSVEASPSHSPATNEYRTLIPVTPAKTGFPGVTEVNIAGDSNSNVIHFLSEDHDSSVHPSERSHTTHGSESAGHSSGSQEGGANTTSGPMRKPQIPEWLIILASLLALALILAVCIAVNSRRRIIRCGQKKKLVINNGNGAVGDRKPSGINGEASKSQEMVHLVNKEPSETPDQYTTADETRNLQNVDMKIGV

SEQ ID NO: 312 - protein, 742 aa, Gorilla gorilla gorilla
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIHPSNPTDDDVSSGSSSERSSTSGGYIFYTFSTAHPIPDEDGPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKENQDWTQWNPSHSNPEVLLQTTTRMTDVDRNGTTAYEGNWNPEAHPPLIHHEHHEEEETPHSTSTIQATPSSTTEGIATQKEQWFGNRWHEGYRQTPREDSHSTTGTAAASAHTSHPMQGRTTPSPEDSSWTDFFDPISHPMGRGHQAGRRMDMDSSHSTTLQPTANPNTDLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNHSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 313 - protein, 744 aa, Felis catus
KTNFLAFAVMYAEVSNISVSSTDLNITCRYAGVFHVEKNGRYSISKTEAADLCKAFNSTLPTMTEMEAALSIGFETCRYGFIEGHVVIPRIHPNSICAANNTGVYILTSNTSQYDTYCFNASAPPGEDCTSVTHLPNAFEGPITITIVNRDGTRYTQTGEYRTNPEDIYPSNPTDDDVSSGSSSERSTSGGYSIFHTHLPTAYPTQDQDSPGTSDNPENPPITTLMSSSGTTSKTATKRREAQDWLSWWFQPSESENHLHTTTIMAGTDSNIISAGWEPTEENEDERDKHPSYSGSGIDDDEDFISSTISTTPRLFNHPKQNQDRTQWSPGESSPGVLLQTTARMTDVDRSSTIANGESWTREPHSPLIHHERHDEEETQHSMSPTQEIPSRTMEETTTQKEQWVESGWHGAYPQPKEDSHSTTGTAAAPAHDSHPDQRMTTQSQEDSSWTYFFDPISHPMGRGHQTERWMDLDSSHSTTLQPSADPNTHSVEELDRTGPLSVTTQQSHTQSFSTSHGDWEEDKDHPVTSTPTSSNRTDGKGGRRSGHLPEDSATSVESSTSRSPATKELRTLIPVTPAKTGVPEVTEVNIAGDSDSNVDRFFSEDQDSPVHPSGRSHTTHGSESAGHTSGSQEGGANTTSGPTRKPQIPEWLIILASLLALALILAVCIAVNSRRRCGQKKKLVINNGNGAVEERKASGLNGEASKSQEMVHLVNKESSVTCDQYMTADETRNLQNVDMKIGV

SEQ ID NO: 314 - protein, 392 aa, Danio rerio
MWTLLFVVFATGSPAVLQAAPVQGNSGRCSFAGVFHIEGISRYSLTFQKAGELCQSLGYRLATQEQVTEAYKKGLRTCRYGWIDGQNVTFLPHINGPNCDSSSAEITFHAKAGEFLSDVYCFDPSDSSPNCDDVKSEDVMNGNAARDSSFYAKPHEDFITEFKTEGFLVDVEEILERVKRETSLLSDMKPSTVPSMKNIEGIKDPTSKPHIGKTPSVLLFDTEGSGSGLVDPEPSHFTTSPVTTETAKSNLIENVIEENEEMVVPVETSNVNPIQVKEPRRVNVFSTTESNAKEMVSDGSSSTWMIITAFCVFIGVIVCIFVAIGTRDKWYGPSKSADITTEKNNKDYSKTETLPLSEKEQEIVALMNVTNMKNGQTVDITAADEHEKEYLM

SEQ ID NO: 315 - protein, 722 aa, Mus musculus
MGRRSALALAVVSALLCQVWSSGVFELKLQEFVNKKGLLGNRNCCRGGSGPPCACRTFFRVCLKHYQASVSPEPPCTYGSAVTPVLGVDSFSLPDGAGIDPAFSNPIRFPFGFTWPGTFSLIIEALHTDSPDDLATENPERLISRLTTQRHLTVGEEWSQDLHSSGRTDLRYSYRFVCDEHYYGEGCSVFCRPRDDAFGHFTCGDRGEKMCDPGWKGQYCTDPICLPGCDDQHGYCDKPGECKCRVGWQGRYCDECIRYPGCLHGTCQQPWQCNCQEGWGGLFCNQDLNYCTHHKPCRNGATCTNTGQGSYTCSCRPGYTGANCELEVDECAPSPCKNGASCTDLEDSFSCTCPPGFYGKVCELSAMTCADGPCFNGGRCSDNPDGGYTCHCPLGFSGFNCEKKMDLCGSSPCSNGAKCVDLGNSYLCRCQAGFSGRYCEDNVDDCASSPCANGGTCRDSVNDFSCTCPPGYTGKNCSAPVSRCEHAPCHNGATCHQRGQRYMCECAQGYGGPNCQFLLPEPPPGPMVVDLSERHMESQGGPFPWVAVCAGVVLVLLLLLGCAAVVVCVRLKLQKHQPPPEPCGGETETMNNLANCQREKDVSVSIIGATQIKNTNKKADFHGDHGAEKSSFKVRYPTVDYNLVRDLKGDEATVRDTHSKRDTKCQSQSSAGEEKIAPTLRGGEIPDRKRPESVYSTSKDTKYQSVYVLSAEKDECVIATEV

SEQ ID NO: 316 - protein, 723 aa, Homo sapiens
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 317 - protein, 685 aa, Homo sapiens
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 318 - protein, 686 aa, Mus musculus
MTPASRSACRWALLLLAVLWPQQRAAGSGIFQLRLQEFVNQRGMLANGQSCEPGCRTFFRICLKHFQATFSEGPCTFGNVSTPVLGTNSFVVRDKNSGSGRNPLQLPFNFTWPGTFSLNIQAWHTPGDDLRPETSPGNSLISQIIIQGSLAVGKIWRTDEQNDTLTRLSYSYRVICSDNYYGESCSRLCKKRDDHFGHYECQPDGSLSCLPGWTGKYCDQPICLSGCHEQNGYCSKPDECICRPGWQGRLCNECIPHNGCRHGTCSIPWQCACDEGWGGLFCDQDLNYCTHHSPCKNGSTCSNSGPKGYTCTCLPGYTGEHCELGLSKCASNPCRNGGSCKDQENSYHCLCPPGYYGQHCEHSTLTCADSPCFNGGSCRERNQGSSYACECPPNFTGSNCEKKVDRCTSNPCANGGQCQNRGPSRTCRCRPGFTGTHCELHISDCARSPCAHGGTCHDLENGPVCTCPAGFSGRRCEVRITHDACASGPCFNGATCYTGLSPNNFVCNCPYGFVGSRCEFPVGLPPSFPWVAVSLGVGLVVLLVLLVMVVVAVRQLRLRRPDDESREAMNNLSDFQKDNLIPAAQLKNTNQKKELEVDCGLDKSNCGKLQNHTLDYNLAPGLLGRGGMPGKYPHSDKSLGEKVPLRLHSEKPECRISAICSPRDSMYQSVCLISEERNECVIATEV

SEQ ID NO: 319 - protein, 714 aa, Rattus norvegicus
MGRRSALALAVVSALLCQVWSSGVFELKLQEFVNKKGLLGNRNCCRGGSGPPCACRTFFRVCLKHYQASVSPEPPCTYGSAVTAVLGVDSFSLPDGAGIDPAFSNPIRFPFGFTWPGTFSLIIEALHTDSPDDLATENPERLISRLTTQRHLTVGEEWSQDLHSSGRTDLRYSYRFVCDEHYYGEGCSVFCRPRDDAFGHFTCGERGEKMCDPGWKGQYCTDPICLPGCDDQHGYCDKPGECKCRVGWQGRYCDECIRYPGCLHGTCQQPWQCNCQEGWGGLFCNQDLNYCTHHKPCRNGATCTNTGQGSYTCSCRPGYTGANCELEVDECAPSPCRNGGSCTDLEDSYSCTCPPGFYGKVCELSAMTCADGPCFNGGRCSDNPDGGYTCHCPAGFSGFNCEKKIDLCSSSPCSNGAKCVDLGNSYLCRCQTGFSGRYCEDNVDDCASSPCANGGTCRDSVNDFSCTCPPGYTGRNCSAPVSRCEHAPCHNGATCHQRGQRYMCECAQGYGGANCQFLLPEPPPDLIVAAQGGSFPWVAVCAGVVLVLLLLLGCAAVVVCVRLKLQKHQPPPDPCGGETETMNNLANCQREKDVSVSIIGATQIKNTNKKADFHGDHGADKSSFKARYPTVDYNLIRDLKGDEATVRDAHSKRDTKCQSQGSVGEEKSTSTLRGGEVPDRKRPESVYSTSKDTKYQSVYVLSAEKDECVIATEV

SEQ ID NO: 320 - protein, 717 aa, Danio rerio
MGRLMIAVLLCVMISQGFCSGVFELKLQEFLNKKGVTGNANCCKGSAAEGHQCECKTFFRICLKHYQANVSPDPPCTYGGAVTPVLGSNSFQVPESFPDSSFTNPIPFAFGFTWPGTFSLIIEALHTDSTDDLSTENPDRLISRMTTQRHLTVGEEWSQDLQVGGRTELKYSYRFVCDEHYYGEGCSVFCRPRDDTFGHFTCGERGEIICNSGWKGQYCTEPICLPGCDEDHGFCDKPGECKCRVGFSGKYCDDCIRYPGCLHGTCQQPWQCNCQEGWGGLFCNQDLNYCTHHKPCQNGATCTNTGQGSYTCSCRPGFTGDSCEIEVNECSGSPCRNGGSCTDLENTYSCTCPPGFYGRNCELSAMTCADGPCFNGGHCADNPEGGYFCQCPMGYAGFNCEKKIDHCSSNPCSNDAQCLDLVDSYLCQCPEGFTGTHCEDNIDECATYPCQNGGTCQDGLSDYTCTCPPGYTGKNCTSAVNKCLHNPCHNGATCHEMDNRYVCACIPGYGGRNCQFLLPENPQGQAIVEGADKRYSYEEDDGGFPWTAVCAGIILVLLVLIGGSVFVIYIRLKLQQRSQQIDSHSEIETMNNLTNNRSREKDLSVSIIGATQVKNINKKVDFQSDGDKNGFKSRYSLVDYNLVHELKQEDLGKEDSERSEATKCEPLDSDSEEKHRNHLKSDSSERKRTESLCKDTKYQSVFVLSEEKDECIIATEV

SEQ ID NO: 321 - protein, 772 aa, Danio rerio
MGRHLLLLLFSILYMLLCQASSSGVFELKLQEFLNKKGVQGNKNCCKGGLTTSYQQCECKTFFRICLKHYQPNASPEPPCTYGGTVTPVLGSNSFQVPDTLPDGSFTNPIRMNFGFTWPGTFSLIIEALHADSKEDLTTENPERIISTMTTQRHLTVGEDWSQDLHSVGRTELKYSYRFVCDEHYYGEGCSVFCRPRDDAFGHFTCGERGEIICDAGWKGQYCTEPICLPGCDEEHGFCEKPGECKCRVGFKGRYCDECIRYPGCLHGTCQQPWQCNCQEGWGGLFCNQDLNYCTHHKPCLNGATCSNTGQGSYTCSCRPGFSGASCEIEVNECTGNPCRNGGSCTDMENTYSCTCPPGFYGKNCELSAMTCADGPCFNGGRCADNPDGGYFCQCPTGYAGFNCEKKIDHCSSSPCSNGARCVDLVNSYLCQCPDGFTGMNCDRAGDECSMYPCQNGGTCQEGASGYMCTCPPGYTGRNCSSPVSRCQHNPCHNGATCHERNNRYVCACVSGYGGRNCQFLLPDRASQIASDVPWTAVGSGVLLVLLLVVACAVVVVCVRSKVQQRRRDREDEVANGENETINNLTNNCHRDKDLAVSVVGVAPVKNINKKIDFSSDHDDLSLTTEKRSYKTRHAPADYNLVHEVKFEVKHEVKLEHAGKETTMANELSDSCEDIKCQSLQDSSECTEEKRRKRLKSDASEKSKYSESRYSESKYSESKYSESKYSDVSLYSESACASACASASTSACVDTKYKSVMVMSEEKDECVIATEV

SEQ ID NO: 322 - protein, 686 aa, Rattus norvegicus
MTPGSRSACRWALLLLAVLWPQQRAAGSGIFQLRLQEFANERGMLANGRPCEPGCRTFFRICLKHYQATFSEGPCTFGNVSTPVLGTNSFVIRDKNSGSGRNPLQLPFNFTWPGTFSLNIQAWHTPGDDLRPETSPGNSLISQIIIQGSLAVGKNWKSDEQNNTLTRLRYSYRVVCSDNYYGDSCSRLCKKRDDHFGHYECQPDGSLSCLPGWTGKYCDQPICLSGCHEQNGYCSKPDECNCRPGWQGPLCNECIPHNGCRHGTCTIPWQCACDEGWGGLFCDQDLNYCTHHSPCKNGSTCSNSGPRGYTCTCLPGYTGEHCELELSKCASNPCRNGGSCKDHENSYHCLCPPGYYGQHCEHSTLTCADSPCFNGGSCRERNQGASYACECPPNFTGSNCEKKVDRCTSNPCANGGQCLNRGPSRTCRCRPGFTGTHCELHISDCARSPCAHGGTCHDLENGPVCTCPAGFSGRRCEVRITNDACASGPCFNGATCYTGLSPNNFVCNCPYGFVGSRCEFPVGLPPSFPWVAVSLGVGLVVLLVLLVMVAVAVRQLRLRRPDDDSREAMNNLSDFQKDNLIPAAQLKNTNQKKELEVDCGLDKSNCGKLQNHTLDYNLAPGFLGRGSTPGKYPHSDKSLGEKVPLRLHSEKPACRISAICSPRDSMYQSVCLISEERNECVIATEV

SEQ ID NO: 323 - protein, 664 aa, Danio rerio
MARVLLTCFFILISSHLGKSSGVFELKVLSFTSTSSVCKGSSDCQIFFRVCLKHSQALILPEPPCTYGTGMSEILSADSISSSAYISVPFNFKWPGIVSLIIETWNAETSDQSTENNNNMISRLATKRRLAISEDWSQDVHLGRQSQLRFSYRVVCDEFYHGEECSDFCRPRNDTFGHFNCDAAGNRICLPGWKGDYCTEPICLSGCSEENGYCEAPGECKCRIGWEGPLCDECTRHPGCLHGTCNQPFQCTCKEGWGGLFCNEDLNFCTNHKPCRNDATCTNTGQGSYTCICKPGFSGKNCEIETNECDSNPCKNGGSCNDQENDYTCTCPQGFYGKNCEVSAMTCADGPCFNGGTCMEKGSGSYSCRCPPGYMGSNCEKKIDRCSSDPCANGGQCLDLGNKATCRCRPGFTGSRCETNIDDCSSNPCQNAGTCVDGINGYTCTCTLGFSGKDCRVRSDACSFMPCQNGGTCYTHFSGPVCQCPAGFMGTQCEYKQKPTPVNSPALPAALIVSFTLGLITLTLVICAAIVVLRQMRQNHKASSTTVRNNLDSVNNRISLSPTSPLGREKEAFLIPGGPFKVSNKDMALRSTSVDTHSSDKSNYKQKMVDYNLSIDEKHTNNKLEKNSESTLLVPPLNYPKEGVYHPVYIIPEHIEQRVFATEV

SEQ ID NO: 324 - protein, 722 aa, Bos taurus
MGGRCALTLAVLSALLCQVWSSGVFELKLQEFVNKKGLLGNRNCCRGGAGPPPCACRTFFRVCLKHYQASVSPEPPCTYGSAVTPVLGTDSFSLPDGAGADPAFSNPIRFPFGFTWPGTFSLIIEALHTDSPDDLATENPERLISRLATQRHLAVGEEWSQDLHSSGRTDLKYSYRFVCDEHYFGEGCSVFCRPRDDAFGHFTCGERGEKVCNPGWKGQYCTEPICLPGCDEQHGFCDKPGECKCRVGWQGRYCDQCIRYPGCLHGTCRQPWQCNCQEGWGGLFCNQDLNYCTHHKPCRNGATCTNTGQGSYTCSCRPGYTGANCETEVDECSAGPCRNGGSCTDLENSYSCTCPPGFYGRICELSAMVCADGPCFNGGRCSDNPEGGYTCRCPGGFSGFNCEKKTDSCSSSPCSNGAQCVDLGDAYACRCQAGFSGRHCDNNVDDCASSPCAHGGTCRDGVNEYSCTCPPGYTGRNCSAPVSRCEHAPCHNGATCHERAFRYLCECARGYGGPNCQFLLPEPPPGPVVVDLTEKYVEGQAGPFPWVAVGAGVLLVLTLLLGCAATVVCVRLRLQKRRPPADPCRGETETMNNLANRQREKDISVSVIGATQIKNTNKKADFHVEPGAEKNGLTARDSAVGCNLLQGLKGAAATAGPHSVRDAKGQPQGSAGEEKGTPTLRGGEASERKRPDSVYSASKDTKYQSVYVISEEQDECVIATEV

SEQ ID NO: 325 - protein, 723 aa, Pan troglodytes; identical to SEQ ID NO: 316

SEQ ID NO: 326 - protein, 723 aa, Macaca mulatta
MGGRCALALAVLSALLCQVWSSGVFELKLQEFVNKKGLLGNRNCCRGGAGPPPCACRTFFRVCLKHYQASVSPEPPCTYGSTVTPVLGVDSFSLPDGAGADPAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDNNVDDCASAPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVVLVLMLLLGCAAVVVCVRLRLQKRRPPADPCRGETETMNNLANCQREKDISVSVIGATQIKNTNKKADFHGDHSADKNGFKARYPTVDYNLVQDLKGDDATVRDTHSKRDTKCQPQGSSGEEKGTPTTLRGGEASERKRPDSGCSTSKDTKYQSVYVISEEKDECVIATEV

SEQ ID NO: 327 - protein, 714 aa, Rattus norvegicus
MGRRSALALAVVSALLCQVWSSGVFELKLQEFVNKKGLLGNRNCCRGGSGPPCACRTFFRVCLKHYQASVSPEPPCTYGSAVTPVLGVDSFSLPDGAGIDPAFSNPIRFPFGFTWPGTFSLIIEALHTDSPDDLATENPERLISRLTTQRHLTVGEEWSQDLHSSGRTDLRYSYRFVCDEHYYGEGCSVFCRPRDDAFGHFTCGERGEKMCDPGWKGQYCTDPICLPGCDDQHGYCDKPGECKCRVGWQGRYCDECIRYPGCLHGTCQQPWQCNCQEGWGGLFCNQDLNYCTHHKPCRNGATCTNTGQGSYTCSCRPGYTGANCELEVDECAPSPCRNGGSCTDLEDSYSCTCPPGFYGKVCELSAMTCADGPCFNGGRCSDNPDGGYTCHCPAGFSGFNCEKKIDLCSSSPCSNGAKCVDLGNSYLCRCQTGFSGRYCEDNVDDCASSPCANGGTCRDSVNDFSCTCPPGYTGRNCSAPVSRCEHAPCHNGATCHQRGQRYMCECAQGYGGANCQFLLPEPPPDLIVAAQGGSFPWVAVCAGVVLVLLLLLGCAAVVVCVRLKLQKHQPPPDPCGGETETMNNLANCQREKDVSVSIIGATQIKNTNKKADFHGDHGADKSSFKARYPTVDYNLIRDLKGDEATVRDAHSKRDTKCQSQGSVGEEKSTSTLRGGEVPDRKRPESVYSTSKDTKYQSVYVLSAEKDECVIATEV

SEQ ID NO: 328 - protein, 740 aa, Gallus gallus
MGGRFLLTLALLSALLCRCQVDGSGVFELKLQEFVNKKGLLSNRNCCRGGGPGGAGLQQCDCKTFFRVCLKHYQASVSPEPPCTYGSAITPVLGANSFSVPDGAGGADPAFSNPIRFPFGFTWPGTFSLIIEALHTDSPDDLTTENPERLISRLATQRHLAVGEEWSQDLHSSGRTDLKYSYRFVCDEHYYGEGCSVFCRPRDDAFGHFTCGERGEKVCNPGWKGQYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGSSCEIEINECDANPCKNGGSCTDLENSYSCTCPPGFYGKNCELSAMTCADGPCFNGGRCTDNPDGGYSCRCPLGYSGFNCEKKIDYCSSSPCANGAQCVDLGNSYICQCQAGFTGRHCDDNVDDCASFPCVNGGTCQDGVNDYSCTCPPGYNGKNCSTPVSRCEHNPCHNGATCHERSNRYVCECARGYGGLNCQFLLPEPPQGPVIVDFTEKYTEGQNSQFPWIAVCAGIILVLMLLLGCAAIVVCVRLKVQKRHHQPEACRSETETMNNLANCQREKDISISVIGATQIKNTNKKVDFHSDNSDKNGYKVRYPSVDYNLVHELKNEDSVKEEHGKCEAKCETYDSEAEEKSAVQLKSSDTSERKRPDSVYSTSKDTKYQSVYVISEEKDECIIATEVSIPPGSRTSLGV

SEQ ID NO: 329 - protein, 726 aa, Pelodiscus sinensis
MGGQSMLTLAILSVLLCHCQVRCSGVFELKLQEFVNKKGLLGNRNCCRGGSGGAGLQQCDCKTFFRVCLQHQQAEITASPACHSQRTFQPILPVSATGGKPGNNSSKSSSNPLSFSCILIFQGTFSLIIEALHTDSPDDLNTENPERLISRLATQRHLTVGEEWSQDLHSNDRTDLKYSYRFVCDEHYYGEGCSVFCRPRDDAFGHFTCGERGEKVCNPGWKGQYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGSNCEIEINECDANPCKNGGSCTDLENSYSCNCPPGFYGKNCELSAMTCADGPCFNGGRCTDNPDGGYSCRCPLGYSGFNCEKKIDYCSSSPCANGAQCVDLGNSYICQCQAGFTGRHCDDNVDDCASFPCLNGGTCQDGINDYSCTCPPGYNGKNCSAPVNKCEHNPCHNGATCHERNNRYVCECARGYGGLNCQFLLPEQPQGPVIVDFTEKYTEGQNAQFPWIAVCAGIILVLMLLLGCAAIVVCVRLKMQKRHHQPDACRSETETMNNLANCQREKDISISVIGATQIKNTNKKVDFHSDNSDKSGYKVRYPSVDYNLVHELKNEDSVKEEHSKCEAKCETYDSEAEEKSAVPLKSSDTSERKRPESVYSTSKDTKYQSVYVISEEKDECIIATEV

SEQ ID NO: 330 - protein, 723 aa, Gorilla gorilla gorilla
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCHPQGSSGEEKGTPTTLRGGEASERKRPDSGCSTSKDTKYQSVYVISEEKDECVIATEV

SEQ ID NO: 331 - protein, 592 aa, Mus musculus
MVSLQVSPLSQTLILAFLLPQALPAGVFELQIHSFGPGPGLGTPRSPCNARGPCRLFFRVCLKPGVSQEATESLCALGAALSTSVPVYTEHPGESAAALPLPDGLVRVPFRDAWPGTFSLVIETWREQLGEHAGGPAWNLLARVVGRRRLAAGGPWARDVQRTGTWELHFSYRARCEPPAVGAACARLCRSRSAPSRCGPGLRPCTPFPDECEAPSVCRPGCSPEHGYCEEPDECRCLEGWTGPLCTVPVSTSSCLNSRVPGPASTGCLLPGPGPCDGNPCANGGSCSETSGSFECACPRGFYGLRCEVSGVTCADGPCFNGGLCVGGEDPDSAYVCHCPPGFQGSNCEKRVDRCSLQPCQNGGLCLDLGHALRCRCRAGFAGPRCEHDLDDCAGRACANGGTCVEGGGSRRCSCALGFGGRDCRERADPCASRPCAHGGRCYAHFSGLVCACAPGYMGVRCEFAVRPDGADAVPAAPRGLRQADPQRFLLPPALGLLVAAGLAGAALLVIHVRRRGPGQDTGTRLLSGTREPSVHTLPDALNNLRLQDGAGDGPSSSADWNHPEDGDSRSIYVIPAPSIYAREDWLIQVLF

SEQ ID NO: 332 - protein, 618 aa, Homo sapiens
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 333 - protein, 589 aa, Rattus norvegicus
MVSLQVSSLPQTLILAFLLPQALPAGVFELQIHSFGPGPGPGTPRSPCNARGPCRLFFRVCLKPGVSQEAAESLCALGAALSTSGPVYTEQPGVPAAALSLPDGLVRVPFLDAWPGTFSLIIETWREQLGERAAGPAWNLLARVAGRRRLAAGAPWARDVQRTGAWELHFSYRARCEPPAVGAACARLCRSRSAPSRCGPGLRPCTPFPDECEAPRESLTVCRAGCSPEHGYCEEPDECHCLEGWTGPLCTVPVSTSSCLNSRVSGPAGTGCLLPGPGPCDGNPCANGGSCSETPGSFECACPRGFYGPRCEVSGVTCADGPCFNGGLCVGGEDPDSAYVCHCPPAFQGSNCERRVDRCSLQPCQNGGLCLDLGHALRCRCRAGFAGPRCEHDLDDCAGRACANGGTCVEGGGARRCSCALGFGGRDCRERADPCASRPCAHGGRCYAHFSGLVCACAPGYMGVRCEFAVRPDGADAVPAAPRGLRQADSQRFLLPPALGLLAAAALAGAALLLIHVRRRGPGRDTGTRLLSGTREPSVHTLPDALNNLRLQDGAGDGPTSSADWNHPEDGDSRSIYVIPAPSIYAREA

SEQ ID NO: 334 - protein, 615 aa, Danio rerio
MAHLSLYCLLSVSLLQLVASSGVFELKVHSFSTTRRFCRRTRDCNIFFRICLKHSEDVISAEPPCTFGTGQTSVLRADQSSIASSAAIRVPFHFKWPGTFSLIIEAWNAESPKEHHDYTENQNNLISRLATRRRLAVGEDWSQDVHFGDQSELRYSYHVFCDEFYFGEACSDYCRPRDDTLGHYTCDENGNKECLVGWQGDYCSDPICSSDCSERHGYCESPGECKCRLGWQGPSCSECVHYPGCLHGTCSQPWQCVCKEGWGGLFCNQDLNYCTNHKPCANGATCTNTGQGSYTCTCRPGFGGTNCELEINECDCNPCKNGGSCNDLENDYSCTCPQGFYGKNCEIIAMTCADDPCFNGGTCEEKFTGGYVCRCPPTFTGSNCEKRLDRCSHKPCANGGECVDLGASALCRCRPGFSGSRCETNIDDCARYPCQNAGTCQDGINDYTCTCTLGFTGKNCSLRADACLTNPCLHGGTCFTHFSGPVCQCVPGFMGSTCEFPVQASLEKMAPRVGQTSPSAVAVSCVLGVLAVFLGVCVGLVVLRRRRHRLRRQQLCDSVFNDLETVNNLDRQHYPYDRDFSQVKPCNTEGRISLAASHTLPAGQEFLWSAGGGLR

SEQ ID NO: 335 - protein, 485 aa, Ciona intestinalis
MSIKLILLLCSVAIGLAVGKPTDTTTCPSRCNLSHGFCNPRQQCTCFPGWEGPECNQCSTLIGCLHGSCDRPGQCNCDVGWGGRKCDRDLQYCERHRPCRNGATCINNLLGGFKCICPTGLTGTTCQETATTTPPITPRSGGKPRCSNGGTCIRGNAELGCESCRCPTGFTGQLCEQIVRMCVMRPCANGGKCQDVIGNFRCDCAHGYRGRYCTEDINECTVLGRHACENGGTCVNRFGGYTCACSEGYYGSRCQSKIIQIQARVTTTVKPTTTTTTTTTTEATTTKSTTETPKEIVVVPNLKKPFRKNIKVTHIVRQVEVETSNGDMTFIRDVVDHQGPNSAENEAQSSVTTVQALTFAFLGVAIALFIGIVIFMWIHCSKKGSNLRQRCTGESPTEETPMNENSREPSIVKTRHASYRPPQYVLEECQPKPGYPMRSVALPSDDMEPIDCLYVALPNNSTPDVASMANRVLNSPSLPAYDERY

SEQ ID NO: 336 - protein, 833 aa, Drosophila melanogaster
MHWIKCLLTAFICFTVIVQVHSSGSFELRLKYFSNDHGRDNEGRCCSGESDGATGKCLGSCKTRFRVCLKHYQATIDTTSQCTYGDVITPILGENSVNLTDAQRFQNKGFTNPIQFPFSFSWPGTFSLIVEAWHDTNNSGNARTNKLLIQRLLVQQVLEVSSEWKTNKSESQYTSLEYDFRVTCDLNYYGSGCAKFCRPRDDSFGHSTCSETGEIICLTGWQGDYCHIPKCAKGCEHGHCDKPNQCVCQLGWKGALCNECVLEPNCIHGTCNKPWTCICNEGWGGLYCNQDLNYCTNHRPCKNGGTCFNTGEGLYTCKCAPGYSGDDCENEIYSCDADVNPCQNGGTCIDEPHTKTGYKCHCANGWSGKMCEEKVLTCSDKPCHQGICRNVRPGLGSKGQGYQCECPIGYSGPNCDLQLDNCSPNPCINGGSCQPSGKCICPAGFSGTRCETNIDDCLGHQCENGGTCIDMVNQYRCQCVPGFHGTHCSSKVDLCLIRPCANGGTCLNLNNDYQCTCRAGFTGKDCSVDIDECSSGPCHNGGTCMNRVNSFECVCANGFRGKQCDEESYDSVTFDAHQYGATTQARADGLTNAQVVLIAVFSVAMPLVAVIAACVVFCMKRKRKRAQEKDDAEARKQNEQNAVATMHHNGSGVGVALASASLGGKTGSNSGLTFDGGNPNIIKNTWDKSVNNICASAAAAAAAAAAADECLMYGGYVASVADNNNANSDFCVAPLQRAKSQKQLNTDPTLMHRGSPAGSSAKGASGGGPGAAEGKRISVLGEGSYCSQRWPSLAAAGVAGACSSQLMAAASVAGSGAGTAQQQRSVVCGTPHM

SEQ ID NO: 337 - protein, 833 aa, Drosophila melanogaster; identical to SEQ ID NO: 336

SEQ ID NO: 338 - protein, 882 aa, Homo sapiens
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 339 - protein, 884 aa, Mus musculus
MGARCRSFSALLLLLQVSSWLCQELEPESCSPGFSSEVYTFPVPERHLERGHVLGRVRFEGCTGRPRTAFFSEDSRFKVATDGTITVKRHLKLHKLETSFLVRARDSSHRELSTKVTLKSMGHHHHRHHHRDPASESNPELLMFPSVYPGLRRQKRDWVIPPISCPENEKGEFPKNLVQIKSNRDKETKVFYSITGQGADKPPVGVFIIERETGWLKVTQPLDREAIAKYILYSHAVSSNGEAVEDPMEIVITVTDQNDNRPEFTQEVFEGSVAEGAVPGTSVMKVSATDADDDVNTYNAAIAYTIVSQDPELPHKNMFTVNRDTGVISVLTSGLDRESYPTYTLVVQAADLQGEGLSTTAKAVITVKDINDNAPVFNPSTYQGQVPENEVNARIATLKVTDDDAPNTPAWKAVYTVVNDPDQQFVVVTDPTTNDGILKTAKGLDFEAKQQYILHVRVENEEPFEGSLVPSTATVTVDVVDVNEAPIFMPAERRVEVPEDFGVGQEITSYTAREPDTFMDQKITYRIWRDTANWLEINPETGAIFTRAEMDREDAEHVKNSTYVALIIATDDGSPIATGTGTLLLVLLDVNDNAPIPEPRNMQFCQRNPQPHIITILDPDLPPNTSPFTAELTHGASVNWTIEYNDAAQESLILQPRKDLEIGEYKIHLKLADNQNKDQVTTLDVHVCDCEGTVNNCMKAGIVAAGLQVPAILGILGGILALLILILLLLLFLRRRTVVKEPLLPPDDDTRDNVYYYDEEGGGEEDQDFDLSQLHRGLDARPEVTRNDVAPTLMSVPQYRPRPANPDEIGNFIDENLKAADSDPTAPPYDSLLVFDYEGSGSEAASLSSLNSSESDQDQDYDYLNEWGNRFKKLADMYGGGEDD

SEQ ID NO: 340 - protein, 3354 aa, Homo sapiens
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 341 - protein, 1507 aa, Drosophila melanogaster [sequence omitted]

SEQ ID NO: 342 - protein, 906 aa, Mus musculus
MCRIAGAPRTLLPLLAALLQASVEASGEIALCKTGFPEDVYSAVLPKDVHEGQPLLNVKFSNCNRKRKVQYESSEPADFKVDEDGTVYAVRSFPLTAEQAKFLIYAQDKETQEKWQVAVNLSREPTLTEEPMKEPHEIEEIVFPRQLAKHSGALQRQKRDWVIPPINLPENSRGPFPQELVRIRSDRDKNLSLRYSVTGPGADQPPTGIFIINPISGQLSVTKPLDRELIARFHLRAHAVDINGNQVENPIDIVINVIDMNDNRPEFLHQVWNGSVPEGSKPGTYVMTVTAIDADDPNALNGMLRYRILSQAPSTPSPNMFTINNETGDIITVAAGLDREKVQQYTLIIQATDMEGNPTYGLSNTATAVITVTDVNDNPPEFTAMTFYGEVPENRVDVIVANLTVTDKDQPHTPAWNAAYRISGGDPTGRFAILTDPNSNDGLVTVVKPIDFETNRMFVLTVAAENQVPLAKGIQHPPQSTATVSVTVIDVNENPYFAPNPKIIRQEEGLHAGTMLTTLTAQDPDRYMQQNIRYTKLSDPANWLKIDPVNGQITTIAVLDRESPNVKNNIYNATFLASDNGIPPMSGTGTLQIYLLDINDNAPQVLPQEAETCETPEPNSINITALDYDIDPNAGPFAFDLPLSPVTIKRNWTINRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRLDERPIHAEPQYPVRSAAPHPGDIGDFINEGLKAADNDPTAPPYDSLLVFDYEGSGSTAGSLSSLNSSSSGGDQDYDYLNDWGPRFKKLADMYGGGDD

SEQ ID NO: 343 - protein, 893 aa, Danio rerio
MYPSGGVMLGLLAALQVAVQGTGAMPCQPGFTENEYNVMTADVITEGQVLLKVDFVDCGRGSGLRFESGDPADFRIDADGTVMAARTLQLTDRKGQSLEIKAKDENSQEQWMVHINFTQPKQVPVILFPRHSVLVKGDDSVNRVKRDWVIPPVNVLENSRKQFPEELVKIQSDKDKSNTLRYSVTGPGADQNPTGLFIIDPISGLLSVTKPLDREHIPNFHLRAHAVDINGNQMENPIDIIINVIDMNDNRPEFTHQIWNGTVDEGAKPGTFVMTVTSQDKDDPNTANGMLRYKILSQTPESPSSNMFTINNKTGKIITVAAGLDREKVPQYTLIIQATDMEGNPTYGLSNTATAVIRLLDVNDNAPEFTRETFHGEVPENRVNVIVTNLTVTDKDEPGTPAWNAVYRIISGDPTGRFSIPTDPVTNEGLVTVVKPVDFEMNRSFMLTVVADNEVPLASGIHRTRQSTATVSIRVIDVNESPNFDPNPKQIKLEEGLPQWSMLTTFTAHDPDRYMQQTISYSKLYDPANWLEIDPNNGRISTIAVLDRESPYVKNNLYNATFMASDNGVPRASGTGTLQIYLLDINDNAPRVFPQEAEVCERPEPNAINITAVDGDLNPNAGPYAFELPNRPSDIRRNWTLTRISGDHAQLSLKISYLESGIYELPISITDSGNLPMSNTTYLRIKVCQCDHHGDCVDMERIMAAGLGTGAIIAILICIIILLVLVLMFVMWMKRRDKERQAKQLLIDPEDDVRDNILKYDEEGGGEEDQDYDLSQLQQPDTLEPDMIKPVGIRRLDERPMHSEPNYPIRSAAPHPGDIGEFIHEGLKAADTDPTAPPYDSLLVFDYEGSGSTAGSLSSLHSSSSGGDQDYDYLNDWGPRFRKLADMYGGNDD

SEQ ID NO: 344 - protein, 713 aa, Homo sapiens
MQPRTPLVLCVLLSQVLLLTSAEDLDCTPGFQQKVFHINQPAEFIEDQSILNLTFSDCKGNDKLRYEVSSPYFKVNSDGGLVALRNITAVGKTLFVHARTPHAEDMAELVIVGGKDIQGSLQDIFKFARTSPVPRQKRSIVVSPILIPENQRQPFPRDVGKVVDSDRPERSKFRLTGKGVDQEPKGIFRINENTGSVSVTRTLDREVIAVYQLFVETTDVNGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIMIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTRQEDLSVGSVLLTVNATDPDSLQHQTIRYSVYKDPAGWLNINPINGTVDTTAVLDRESPFVDNSVYTALFLAIDSGNPPATGTGTLLITLEDVNDNAPFIYPTVAEVCDDAKNLSVVILGASDKDLHPNTDPFKFEIHKQAVPDKVWKISKINNTHALVSLLQNLNKANYNLPIMVTDSGKPPMTNITDLRVQVCSCRNSKVDCNAAGALRFSLPSVLLLSLFSLACL

SEQ ID NO: 345 - protein, 906 aa, Homo sapiens
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 346 - protein, 912 aa, Gallus gallus
MCRIAGTPPRILPPLALMLLAALQQAPIKATCEDMLCKMGFPEDVHSAVVSRSVHGGQPLLNVRFQSCDENRKIYFGSSEPEDFRVGEDGVVYAERSFQLSAEPTEFVVSARDKETQEEWQMKVKLTPEPAFTGASEKDQKKIEDIIFPWQQYKDSSHLKRQKRDWVIPPINLPENSRGPFPQELVRIRSDRDKSLSLRYSVTGPGADQPPTGIFIINPISGQLSVTKPLDREQIASFHLRAHAVDVNGNQVENPIDIVINVIDMNDNRPEFLHQVWNGTVPEGSKPGTYVMTVTAIDADDPNAQNGMLRYRILSQAPSSPSPNMFTINNETGDIITVAAGLDREKVQQYTLIIQATDMEGNPTYGLSNTATAVITVTDVNDNPPEFTAMTFYGEVPENRVDVIVANLTVTDKDQPHTPAWNARYQMTGGDPTGQFTILTDPNSNDGLVTVVKPIDFETNRMFVLTVAAENQVPLAKGIQHPPQSTATVSITVIDVNESPYFVPNPKLVRQEEGLLAGSMLTTFTARDPDRYMQQTSLRYSKLSDPANWLKIDPVNGQITTTAVLDRESIYVQNNMYNATFLASDNGIPPMSGTGTLQIYLLDINDNAPQVNPKEATTCETLQPNAINITAVDPDIDPNAGPFAFELPDSPPSIKRNWTIVRISGDHAQLSLRIRFLEAGIYDVPIVITDSGNPHASSTSVLKVKVCQCDINGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRLDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 347 - protein, 3354 aa, Mus musculus
MRYSLVTCYAVLWLLMLVPGSWGQVNRLPFFTNHFFDTYLLISEDTPVGSSVTQLLARDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSPFFAIDSARGIVTVIQELDYEVTQAYQLTVNATDQDKTRPLSTLANLAIIITDMQDMDPIFINLPYSTNIYEHSPPGTTVRVITAVDQDKGRPRGIGYTIVSGNTNSIFALDYISGALTLNGLLDRENPLYSHGFILTVKGTELNDDRTPSDATVTTTFNILVIDINDNAPEFNSSEYSVAITELAQVGFALPLFIQVVDKDEDLGLNSMFEVYLVGNNSHHFIISPTSVQGKADIRIRVAIPLDYETVDRYDFDLFANESVPDHVGYAKVKITLINENDNRPIFSQPLYNVSLYENITVGTSVLTVLATDNDVGTFGEVNYFFSDDPDRFSLDKDTGLIMLIARLDYELIQRFTLTVIARDGGGEETTGRVRINVLDVNDNVPTFQKDAYVGALRENEPSVTQLVRLRATDEDSPPNNLITYSIVNASAFGSYFDISIYEGYGVISVSRPLDYEQIPNGLIYLTVMAKDAGNPPLYSTVPVTIEVFDENDNPPTFSKPAYFVSVLENIMAGATVLFLNATDLDRSREYGQESIIYSLEGSSQFRINARSGEITTTSLLDRETKSEYILIVRAVDGGVGHNQKTGIATVNVTLLDINDNHPTWKDAPYYINLVEMTPPDSDVTTVVAVDPDLGENGTLVYSIHPPNKFYSLNSTTGKIRTTHVMLDRENPDPVEAELMRKIIVSVTDCGRPPLKATSSATVFVNLLDLNDNDPTFRNLPFVAEILEGTPAGVSVYQVVAIDLDEGLNGLVSYRMQVGMPRMDFVINSTSGVVTTTAELDRERIAEYQLRVVASDAGTPTKSSTSTLTVRVLDVNDETPTFFPAVYNVSVSEDVPREFRVVWLNCTDNDVGLNAELSYFITAGNVDGKFSVGYRDAVVRTVVGLDRETTAAYTLVLEAIDNGPVGKRRTGTATVFVTVLDVNDNRPIFLQSSYEASVPEDIPEGHSIVQLKATDADEGEFGRVWYRILHGNHGNNFRIHVGSGLLMRGPRPLDRERNSSHVLMVEAYNHDLGPMRSSVRVIVYVEDVNDEAPVFTQQQYNRLGLRETAGIGTSVIVVRATDKDTGDGGLVNYRILSGAEGKFEIDESTGLIVTVDYLDYETKTSYLMNVSATDGAPPFNQGFCSVYVTLLNELDEAVQFSNASYEAVIMENLALGTEIVRVQAYSIDNLNQITYRFDAYTSAQAKALFKIDAITGVITVKGLVDREKGDFYTLTVVADDGGPKVDSTVKVYITVLDENDNSPRFDFTSDSAISVPEDCPVGQRVATVKARDPDAGSNGQVVFSLASGNIAGAFEIITSNDSIGEVFVAKPLDREELDHYILKVVASDRGTPPRKKDHILQVTILDVNDNPPVIESPFGYNVSVNENVGGGTSVVQVRATDRDIGINSVLSYYITEGNEDMTFRMDRISGEIATRPAPPDRERQNFYHLVVTVEDEGTPTLSATTHVYVTIVDENDNAPVFQQPHYEVVLDEGPDTINTSLITVQALDLDEGPNGTVTYAIVAGNIINTFRINKHTGVITAAKELDYEISHGRYTLIVTATDQCPILSHRLTSTTTVLVNVNDINDNVPTFPRDYEGPFDVTEGQPGPRVWTFLAHDRDSGPNGQVEYSVVDGDPLGEFVISPVEGVLRVRKDVELDRETIAFYNLTICARDRGVPPLSSTMLVGIRVLDINDNDPVLLNLPMNVTISENSPVSSFVAHVLASDADSGCNALLTFNITAGNRERAFFINATTGIVTVNRPLDRERIPEYRLTVSVKDNPENPRIARKDFDLLLVSLADENDNHPLFTEGTYQAEVMENSPAGTPLTVLNGPILALDADEDVYAVVTYQLLGTHSDLFVIDNSTGVVTVRSGIIIDREAFSPPFLELLLLAEDIGQLNGTAHLFITILDDNDNWPTFSPPTYTVHLLENCPPGFSVLQVTATDEDSGLNGELVYRIEAGAQDRFLIHPVTGVIRVGNATIDREEQESYRLTVVATDRGTVPLSGTAIVTILIDDINDSRPEFLNPIQTVSVLESAEPGTIIANVTAIDLDLNPKLEYHIISIVAKDDTDRLVPDQEDAFAVNINTGSVMVKSPLNRELVATYEVTLSVIDNASDLPEHSVSVPNAKLTVNILDVNDNTPQFKPFGITYYTERVLEGATPGTTLIAVAAVDPDKGLNGLITYTLLDLTPPGYVQLEDSSAGKVIANRTVDYEEVHWLNFTVRASDNGSPPRAAEIPVYLEIVDINDNNPIFDQPSYQEAVFEDIAVGTVILRVTATDADSGNFALIEYSLVDGEGKFAINPNTGDISVLSSLDREKKDHYILTALAKDNPGDVASNRRENSVQVVIRVLDVNDCRPQFSKPQFSTSVYENEPAGTSVITMLATDQDEGSNSQLTYSLEGPGMEAFSVDMDSGLVTTQRPLQSYERFNLTVVATDGGEPPLWGTTMLLVEVIDVNDNRPVFVRPPNGTILHIKEEIPLRSNVYEVYATDNDEGLNGAVRYSFLKTTGNRDWEYFTIDPISGLIQTAQRLDREKQAVYSLILVASDLGQPVPYETMQPLQVALEDIDDNEPLFVRPPKGSPQYQLLTVPEHSPRGTLVGNVTGAVDADEGPNAIVYYFIAAGDEDKNFHLQPDGRLLVLRDLDRETEATFSFIVKASSNRSWTPPRGPSPALDLLTDLTLQEVRVVLEDINDQPPRFTKAEYTAGVATDAKVGSELIQVLALDADIGNNSLVFYGILAIHYFRALANDSEDVGQVFTMGSVDGILRTFDLFMAYSPGYFVVDIVARDLAGHNDTAIIGIYILRDDQRVKIVINEIPDRVRGFEEEFIRLLSNITGAIVNTDDVQFHVDMKGRVNFAQTELLIHVVNRDTNRILDVDRVIQMIDENKEQLRNLFRNYNVLDVQPAISVQLPDDMSALQMAIIVLAILLFLAAMLFVLMNWYYRTIHKRKLKAIVAGSAGNRGFIDIMDMPNTNKYSFDGSNPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIHTDLEEEPGDHSPGQGSLRFRHKPPMELKGQDGIHMVHGSTGTLLATDLNSLPEDDQKGLDRSLETLTASEATAFERNARTESAKSTPLHKLRDVIMESPLEITEL

SEQ ID NO: 348 - protein, 906 aa, Rattus norvegicus
MCRIAGGPRTLLPLLAALLQASLEASGELALCKTGFPEDVYSAVLPKTVHEGQPLLNVKFSNCNRKRKVQYESSEPADFKVDEDGTVYAVRSFPLSAEQAKFLIYAQDKETQEKWQVAVNLSLEPSLTEEPMKEPHEIEEIVFPRQLAKHSGALQRQKRDWVIPPINLPENSRGPFPQELVRIRSDRDKNLSLRYSVTGPGADQPPTGIFIINPISGQLSVTKPLDRELIARFHLRAHAVDINGNQVENPIDIVINVIDMNDNRPEFLHQVWNGSVPEGSKPGTYVMTVTAIDADDPNALNGMLRYRILSQAPSTPSPNMFTINNETGDIITVAAGLDREKVQQYTLIIQATDMEGNPTYGLSNTATAVITVTDVNDNPPEFTAMTFYGEVPENRVDVIVANLTVTDKDQPHTPAWNAAYRISGGDPTGRFAILTDPNSNDGLVTVVKPIDFETNRMFVLTVAAENQVPLAKGIQHPPQSTATVSVTVIDVNENPYFAPNPKIIRQEEGLHAGTMLTTLTAQDPDRYMQQNIRYTKLSDPANWLKIDPVNGQITTIAVLDRESPNVKNNIYNATFLASDNGIPPMSGTGTLQIYLLDINDNAPQVLPQEAETCETPEPNSINITALDYDIDPNAGPFAFDLPLSPATIKRNWTITRLNGDFAQLNLKIKFLEAGIYEVPIVITDSGNPPKSNISILRVKVCQCDSNGDCTDVDRIVGAGLGTGTIIAILLCIIILLILVLMFVVWMKRRDKERQAKQLLIDPEDDVRDNILKYDEEGGGEEDQDYDLSQLQQPDTVEPDAIKPVGIRRLDERPIHAEPQYPVRSAAPHPGDIGDFINEGLKAADNDPTAPPYDSLLVFDYEGSGSTAGSLSSLNSSSSGGDQDYDYLNDWGPRFKKLADMYGGGDD

SEQ ID NO: 349 - protein, 3097 aa, Drosophila melanogaster
MAARRCLNQLRQRYITNRFNICTCAIFLISLPFILAIEETTFAGLSAENAARMLAGSPGDVEKSSLSHHSEMSLVLPHDTYPGFSIKKFKTHPVKINGSSHSGAAAYHMLDTDYSKYFTVLEDGVVMTTADISPLVNRPVQLVVVEQTPNATNTHNLQLFVMHRNDMLRFSGSLLDASGEVRENQPAGTRVRGVPLMQAFSGSILDEELATPKKVRYTIIDGNVDDAFALQERKANKNIQISAKSLVINGDDESGVWLVTNRPLDREERAHYDLSVEASDVDGLDRTVSKIQITVLDENDNRPIFKSLDYKFAIAGQKSASMESNSSVTYQRFAIMGKVEATDADGDKIAYRLKSPSNVVIIVPQTGEIMLAGEPTSNELLIEVIAHDLRYPSLVSAKPAKVLLEFLAAEPVSFIMQHLEHDDINNHSHHREKRRVTRAVRPTKRIEFTEADGDTEGKSVFQLEKETDKETFKIRDDNPWVTVETNGAVRVKKKWDYEELGPEKTIDFWVIITNMGHNAGIKYTDNQRVIILVKDVNDEPPYFINRPLPMQAVVQLNAPPNTPVFTLQARDPDTDHNIHYFIVRDRTGGRFEVDERSGVVRTRGTDLFQLDMEYVLYVKAEDQNGKVDDRRFQSTPEERLSIVGGKRAPQFYMPSYEAEIPENQKKDSDIISIKAKSFADREIRYTLKAQGQGAGTFNIGPTSGIVKLAKELDFEDLRQPHVYSLIVTATEDSGGFSTSVDLTIRVTDVNDNAPKFELPDYQAHNVDEDIPLGTSILRVKAMDSDSGSNAEIEYLVSDDHFAVDSNGIIVNNKQLDADNNNAYYEFIVTAKDKGEPPKSGVATVRVYTKNKNDEEPKFSQQVYTPNVDENAGPNTLVTTVVASDKDGDNVRFGFVGGGTSSGQFVIEDITGVIRLHNKAISLDKDKYELNVTAMDDGSCCVNGDQTIHTSTAVVVVFITDVNDNKPVFKDCSTYYPKVEEGAPNGSPVIKVVATDEDKGVNGQVKYSIVQQPNQKGTKFTVDEETGEVSTNKVFDREGDDGKFVSVTVKATDQGDPSLEGVCSFTVEITDVNDNPPLFDRQKYVENVKQDASIGTNILRVSASDEDADNNGAIVYSLTAPFNPNDLEYFEIQAESGWIVLKKPLDRETYKLEAMAQDKGYPPLSRTVEVQIDVVDRANNPPVWDHTVYGPIYVKENMPVGGKVVSIKASSGIEGNPTVFYRLMPGSTAQTNKFHTFYLQQRPDNGDTWADIKVNHPLDYESIKEYNLTIRVENNGAQQLASEATVYIMLEDVNDEIPLFTEREQETVLEGEPIGTKVTQVNAIDKDGTFPNNQVYYYIVDSPRNEGKEFFEINLQSGEIFTKTVFDREKKGAYALEVEARDGAPSARPNSNGPNSVTKFIRIGIADKNDNPPYFDKSLYEAEVDENEDIQHTVLTVTAKDHDESSRIRYEITSGNIGGAFAVKNMTGAIYVAGALDYETRRRYELRLAASDNLKENYTTVIIHVKDVNDNPPVFERPTYRTQITEEDDRNLPKRVLQVTATDGDKDRPQNIVYFLTGQGIDPDNPANSKFDINRTTGEIFVLKPLDRDQPNGRPQWRFTVFAQDEGGEGLVGYADVQVNLKDINDNAPIFPQGVYFGNVTENGTAGMVVMTMTAVDYDDPNEGSNARLVYSIEKNVIEEETGSPIFEIEPDTGVIKTAVCCLDRERTPDYSIQVVAMDGGGLKGTGTASIRVKDINDMPPQFTKDEWFTEVDETDGTALPEMPILTVTVHDEDETNKFQYKVIDNSGYGADKFTMVRNNDGTGSLKIVQPLDYEDQLQSNGFRFRIQVNDKGEDNDNDKYHVAYSWVVVKLRDINDNKPHFERANVEVSVFEDTKVGTELEKFKATDPDQGGKSKVSYSIDRSSDRQRQFAINQNGSVTIQRSLDREVVPRHQVKILAIDDGSPPKTATATLTVIVQDINDNAPKFLKDYRPVLPEHVPPRKVVEILATDDDDRSKSNGPPFQFRLDPSADDIIRASFKVEQDQKGANGDGMAVISSLRSFDREQQKEYMIPIVIKDHGSPAMTGTSTLTVIIGDVNDNKMQPGSKDIFVYNYQGQSPDTPIGRVYVYDLDDWDLPDKKFYWEAMEHPRFKLDEDSGMVTMRAGTREGRYHLRFKVYDRKHTQTDIPANVTVTVREIPHEAVVNSGSVRLSGISDEDFIRVWNYRTQSMSRSKMDRFRDKLADLLNTERENVDIFSVQLKRKHPPLTDVRFSAHGSPYYKPVRLNGIVLMHREEIEKDVGINITMVGIDECLYENQMCEGSCTNSLEISPLPYMVNANKTALVGVRVDTIADCTCGARNFTKPESCRTTPCHNGGRCVDTRFGPHCSCPVGYTGPRCQQTTRSFRGNGWAWYPPLEMCDESHLSLEFITRKPDGLIIYNGPIVPPERDETLISDFIALELERGYPRLLIDFGSGTLELRVKTKKTLDDGEWHRIDLFWDTESIRMVVDFCKSAEIAEMEDGTPPEFDDMSCQARGQIPPFNEYLNVNAPLQVGGLYREQFDQSLYFWHYMPTAKGFDGCIRNLVHNSKLYDLAHPGLSRNSVAGCPQTEEVCAQTETTARCWEHGNCVGSLSEARCHCRPGWTGPACNIPTIPTTFKAQSYVKYALSFEPDRFSTQVQLRFRTREEYGELFRVSDQHNREYGILEIKDGHLHFRYNLNSLRTEEKDLWLNAIVVNDGQWHVVKVNRYGSAATLELDGGEGRRYNETFEFVGHQWLLVDKQEGVYAGGKAEYTGVRTFEVYADYQKSCLDDIRLEGKHLPLPPAMNGTQWGQATMARNLEKGCPSNKPCSNVICPDPFECVDLWNVYECTCGEGRIMSPDSKGCMDRNECLDMPCMNGATCINLEPRLRYRCICPDGFWGENCELVQEGQTLKLSMGALAAILVCLLIILILVLVFVVYNRRREAHIKYPGPDDDVRENIINYDDEGGGEDDMTAFDITPLQIPIGGPMPPELAPMKMPIMYPVMTLMPGQEPNVGMFIEEHKKRADGDPNAPPFDDLRNYAYEGGGSTAGSLSSLASGTDDEQQEYDYLGAWGPRFDKLANMYGPEAPNPHNTELEL

SEQ ID NO: 350 - protein, 829 aa, Homo sapiens
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 351 - protein, 784 aa, Homo sapiens
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 352 - protein, 784 aa, Mus musculus
MQRLTELATALGAFLGLLAVAAMAGPNFPQIDTPNMLPAHHRQKRDWIWNQMHIDEEKNESLPHYVGKIKSNVNRQNAKYVLQGEFAGKIFGVDANTGNVLAYERLDREKVSEYFLTALIVDKNTNKNLEQPSSFTVKVHDINDNWPVFSHQVFNASVPEMSAIGTSVIRVTAVDADDPTVAGHATVLYQIVKGNEYFSIDNSGLIFTKIKNLDREKQAEYKIVVETQDALGLRGESGTATVMIRLEDINDNFPVFTQSTYTFSVPEDIRVGKPLGFLTVVDPDEPQNRMTKYSIMQGEYRDTFTIETDPKRNEGIIKPTKSLDYEVIQQYTFYIEATDPTIRYEYLSSTSGKNKAMVTINVLDVDEPPVFQRHFYHFKLPENQKKPLIGTVVAKDPDKAQRSIGYSIRKTSDRGQFFRITKQGNIYNEKELDRETYAWYNLTVEANELDSRGNPVGKESIVQVYIEVLDENDNPPEFAQPYEPKVCENAAQGKLVVQISATDKDVVPVNPKFKFALKNEDSNFTLINNHDNTANITVKYGQFNREHAKFHYLPVLISDNGVPSLTGTSTLTVGVCKCNEQGEFTFCEEMAAQAGVSIQALVAIFLCILTITVITLLIILRRRIRKQAHAHSKSALEIHEQLVTYDEEGGGEMDTTSYDVSVLNSVRGGSTKPLRSTMDARPAVYTQVQKPPRLAPGLHGGPREMATMIDVKKEEADNDGGGPPYDTLHIYGYEGAESIAESLSSLSTNSSDSDIDYDFLNDWGPRFKMLAELYGSDPQEELII

SEQ ID NO: 353 - protein, 886 aa, Rattus norvegicus
MGARCRSFSALLLLLQVSSWLCQQPESESDSCRPGFSSEVYTFLVPERHLERGHILGRVKFEGCTGRPRTAFFSEDSRFKVSTDGVITVKRHLKLHKLETSFLVHAWDSSYRKLSTKVTLKSLGHHHHRHHHRDPVSESNPELLTFPSFHQGLRRQKRDWVIPPINCPENQKGEFPQRLVQIKSNRDKETTVFYSITGPGADKPPVGVFIIERETGWLKVTQPLDREAIDKYLLYSHAVSSNGEAVEDPMEIVVTVTDQNDNRPEFIQEVFEGSVAEGALPGTSVMQVSATDADDDINTYNAAIAYTILSQDPELPHKNMFTVNRDTGVISVVTSGLDRESYPTYTLVVQAADLQGEGLSTTAKAVITVKDINDNAPIFNPSTYQGQVLENEVGARIATLKVTDDDAPNTPAWNAVYTVVNDPDHQFTVITDPKTNEGILKTAKGLDFEAKQQYILHVTVENEEPFEGSLVPSTATVTVDVVDVNEAPIFVPAEKRVEVPEDFGVGLEIASYTAREPDTFMEQKITYRIWRDTANWLEINPETGVISTRAEMDREDSEHVKNSTYTALIIATDDGSPIATGTGTLLLVLSDVNDNAPIPEPRNMQFCQRNPKPHVITILDPDLPPNTSPFTAELTHGASVNWTIEYNDAEQESLILQPRKDLEIGEYKINLKLSDNQNKDQVTTLEVHVCDCEGTVNNCMKAISLEAGLQVPAILGILGGILALLILILLLLLFLRRRTVVKEPLLPPDDDTRDNVYYYDEEGGGEEDQDFDLSQLHRGLDARPEVIRNDVAPTLMSMPQYRPRPANPDEIGNFIDENLKAADSDPTAPPYDSLLVFDYEGSGSEAASLSSLNSSESDQDQDYDYLNEWGNRFKKLADMYGGGEED

SEQ ID NO: 354 - protein, 714 aa, Mus musculus
MQPRTPLTLCVLLSQVLLVTSADDLECTPGFQRKVLHIHQPAEFIEDQPVLNLTFNDCKGNEKLHYEVSSPHFKVNSDGTLVALRNITAVGRTLFVHARTPHAEDMAELVIVGGKDIQGSLQDIFKFARTSPVPRQKRSIVVSPILIPENQRQPFPRDVGKVVDSDRPEGSKFRLTGKGVDQDPKGTFRINENTGSVSVTRTLDRETIATYQLYVETTDASGKTLEGPVPLEVIVIDQNDNRPIFREGPYIGHVMEGSPTGTTVMRMTAFDADDPATDNALLRYNIRQQTPDKPSPNMFYIDPEKGDIVTVVSPALLDRETLENPKYELIIEAQDMAGLDVGLTGTATATIVIDDKNDHSPKFTKKEFQATVEEGAVGVIVNLTVEDKDDPTTGAWRAAYTIINGNPGQSFEIHTNPQTNEGMLSVVKPLDYEISAFHTLLIKVENEDPLVPDVSYGPSSTATVHITVLDVNEGPVFYPDPMMVTKQENISVGSVLLTVNATDPDSLQHQTIRYSIYKDPAGWLSINPINGTVDTTAVLDRESPFVHNSVYTALFLAIDSGNPPATGTGTLLITLEDINDNAPVIYPTVAEVCDDARNLSVVILGASDKDLHPNTDPFKFEIHKQTVPDKVWKISKINNTHALVSLLQNLNKANYNLPIMVTDSGKPPMTNITDLRVQVCSCKNSKVDCNGAGALHLSLSLLLLFSLLSLLSGL

SEQ ID NO: 355 - protein, 885 aa, Canis lupus familiaris
MGPRYGGAPALLLPLLLLLQVSSGLCQEPEPCRPGFGADSYTFTVPRRHLERGRVLGRVSFEGCTGLPRTAYVSDDTRFKVGTDGVITVKRPLQLHKPEISFLVHAWDSSRRKLSTRVRLKAATHHHHHHHDAPSKTQTEVLTFPSSQHGLRRQKRDWVIPPISCPENEKGPFPKNLVQIKSNRDKEIKVFYSITGQGADAPPVGVFIIERETGWLKVTEPLDREQIAKYILYSHAVSSNGNAVEDPMEIVITVTDQNDNKPEFTQAVFQGSVTEGALPGTSVMQVTATDADDDVNTYNAAIAYSILTQDPLLPSSMMFTINKDTGVISVLTTGLDREGVPMYTLVVQAADLQGEGLTTTATAVITVTDINDNPPIFNPTTYQGRVPENKANVEIAVLKVTDADVPDTPAWRAVYTILNNNNDQFVVTTDPVTNDGILKTTKGLDFEDKQQYVLYVTVVNVTPFEVILSTSTATVTVDVEDVNEAPIFIPCPKVVSIPEDFGVGQEITSYTAEDPDTYMEQRITYRIWRDAAGWLEVNPESGAIFTRAELDREDFEHVKNSTYEALIIAIDNGSPVATGTGTLLLVLSDVNDNGPIPEPRNMDFCQKNPQPHVINIIDPDLPPNTSPFTAELTHGASVNWTIEYNDPARESLILKPKKTLELGDYKINLKLTDNQNKDQVTTLDVFVCDCEGVVNSCKRTAPYAEAGLQVPAILGILGGILALLILILLLLLFVRRRRVVKEPLLPPEDDTRDNVYYYDEEGGGEEDQDFDLSQLHRGLDARPEVTRNDVAPTLLSVPQYRPRPANPDEIGNFIDENLKAADTDPTAPPYDSLLVFDYEGSGSEAASLSSLNSSESDQDQDYDYLNEWGNRFKKLADMYGGGEDD

SEQ ID NO: 356 - protein, 712 aa, Gallus gallus
MQHKTQLTLSFLLSQVLLLACAEDLECTPGFQQKVFYIEQPFEFTEDQPILNLVFDDCKGNNKLNFEVSNPDFKVEHDGSLVALKNVSEAGRALFVHARSEHAEDMAEILIVGADEKHDALKEIFKIEGNLGIPRQKRAILATPILIPENQRPPFPRSVGKVIRSEGTEGAKFRLSGKGVDQDPKGIFRINEISGDVSVTRPLDREAIANYELEVEVTDLSGKIIDGPVRLDISVIDQNDNRPMFKEGPYVGHVMEGSPTGTTVMRMTAFDADDPSTDNALLRYNILKQTPTKPSPNMFYIDPEKGDIVTVVSPVLLDRETMETPKYELVIEAKDMGGHDVGLTGTATATILIDDKNDHPPEFTKKEFQATVKEGVTGVIVNLTVGDRDDPATGAWRAVYTIINGNPGQSFEIHTNPQTNEGMLSVVKPLDYEISAFHTLLIKVENEDPLIPDIAYGPSSTATVQITVEDVNEGPVFHPNPMTVTKQENIPIGSIVLTVNATDPDTLQHQTIRYSVYKDPASWLEINPTNGTVATTAVLDRESPHVQDNKYTALFLAIDSGNPPATGTGTLHITLEDVNDNVPSLYPTLAKVCDDAKDLRVVVLGASDKDLHPNTDPFKFELSKQSGPEKLWRINKLNNTHAQVVLLQNLKKANYNIPISVTDSGKPPLTNNTELKLQVCSCKKSRMDCSASDALHISMTLILLSLFSLFCL

SEQ ID NO: 357 - protein, 986 aa, Mus musculus
MAVRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDLATKTFPNWMENPWVKVDTIAADESFSQVDLGGRVMKINTEVRSFGPVSRNGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIKEKLPLIVGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 358 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 359 - protein, 977 aa, Mus musculus
MELRAVGFCLALLWGCALAAAAAQGKEVVLLDFAAMKGELGWLTHPYGKGWDLMQNIMDDMPIYMYSVCNVVSGDQDNWLRTNWVYREEAERIFIELKFTVRDCNSFPGGASSCKETFNLYYAESDVDYGTNFQKRQFTKIDTIAPDEITVSSDFEARNVKLNVEERMVGPLTRKGFYLAFQDIGACVALLSVRVYYKKCPEMLQSLARFPETIAVAVSDTQPLATVAGTCVDHAVVPYGGEGPLMHCTVDGEWLVPIGQCLCQEGYEKVEDACRACSPGFFKSEASESPCLECPEHTLPSTEGATSCQCEEGYFRAPEDPLSMSCTRPPSAPNYLTAIGMGAKVELRWTAPKDTGGRQDIVYSVTCEQCWPESGECGPCEASVRYSEPPHALTRTSVTVSDLEPHMNYTFAVEARNGVSGLVTSRSFRTASVSINQTEPPKVRLEDRSTTSLSVTWSIPVSQQSRVWKYEVTYRKKGDANSYNVRRTEGFSVTLDDLAPDTTYLVQVQALTQEGQGAGSKVHEFQTLSTEGSANMAVIGGVAVGVVLLLVLAGVGLFIHRRRRNLRARQSSEDVRFSKSEQLKPLKTYVDPHTYEDPNQAVLKFTTEIHPSCVARQKVIGAGEFGEVYKGTLKASSGKKEIPVAIKTLKAGYTEKQRVDFLSEASIMGQFSHHNIIRLEGVVSKYKPMMIITEYMENGALDKFLREKDGEFSVLQLVGMLRGIASGMKYLANMNYVHRDLAARNILVNSNLVCKVSDFGLSRVLEDDPEATYTTSGGKIPIRWTAPEAISYRKFTSASDVWSYGIVMWEVMTYGERPYWELSNHEVMKAINDGFRLPTPMDCPSAIYQLMMQCWQQERSRRPKFADIVSILDKLIRAPDSLKTLADFDPRVSIRLPSTSGSEGVPFRTVSEWLESIKMQQYTEHFMVAGYTAIEKVVQMSNEDIKRIGVRLPGHQKRIAYSLLGLKDQVNTVGIPI

SEQ ID NO: 360 - protein, 986 aa, Mus musculus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 361 - protein, 984 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 362 - protein, 986 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 363 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 364 - protein, 984 aa, Mus musculus
MALDCLLLFLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPSEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAAYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLSEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGVTLAGHQKKILSSIHSMRVQMNQSPSVMA

SEQ ID NO: 365 - protein, 983 aa, Homo sapiens
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 366 - protein, 205 aa, Homo sapiens
MEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKITHSPQAHDNPQEKRLAADDPEVRVLHSIGHSAAPRLFPLAWTVLLLPLLLLQTP

SEQ ID NO: 367 - protein, 976 aa, Homo sapiens
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRMTLRLPSLSGSDGIPYRTVSEWLESIRMKRYILHFHSAGLDTMECVLELTAEDLTQMGITLPGHQKRILCSIQGFKD

SEQ ID NO: 368 - protein, 998 aa, Mus musculus
MVVQTRFPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIVENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVQLSWQEPEHPNGVITEYEIKYYEKDQRERTYSTLKTKSTSASINNLKPGTVYVFQIRAVTAAGYGNYSPRLDVATLEEASGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKDRAERPKFEQIVGILDKMIRNPSSLKTPLGTCSRPLSPLLDQSTPDFTAFCSVGEWLQAIKMERYKDNFTAAGYNSLESVARMTIDDVMSLGITLVGHQKKIMSSIQTMRAQMLHLHGTGIQV

SEQ ID NO: 369 - protein, 987 aa, Homo sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 370 - protein, 228 aa, Mus musculus
MLHVEMLTLLFLVLWMCVFSQDPGSKVVADRYAVYWNSSNPRFQRGDYHIDVCINDYLDVFCPHYEDSVPEDKTERYVLYMVNFDGYSACDHTSKGFKRWECNRPHSPNGPLKFSEKFQLFTPFSLGFEFRPGREYFYISSAIPDNGRRSCLKLKVFVRPTNSCMKTIGVHDRVFDVNDKVENSLEPADDTVHESAEPSRGENAAQTPRIPSRLLAILLFLLAMLLTL

SEQ ID NO: 371 - protein, 998 aa, Homo sapiens
MARARPPPPPSPPPGLLPLLPPLLLLPLLLLPAGCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQDMRLQMNQTLPVQV

SEQ ID NO: 372 - protein, 1122 aa, Caenorhabditis elegans
MRLYNSRILNPHQSIFILVLQCLITIVTSHQEVLFDLSKVGSDLKWDQVSLRHDRDDVWMEETWRNPAATDEKHANQRAYVTCNYDMINPSNWLFSHFIEVKTARRIYIELLFNTRDCDAYLNPKSCKETFSVYLKQFKTSRPGSTKIEKERFSEDIDNWKNIGRLARSNSNMTTETLGMEIDSDTKTIRIAFEEQGICLSLLNVKIYYRICDEFTDQLVYFRPQVTGPKETDMVRMNGSCIPNASKKIPGVDLIGLCMSTGSGIKTSGECVCDSGYSQIADSNGARCESCPTNTYKPKGQSLCKSCPSNSISSEAASSCRCLNGYFRAEDELISMPCTQPPSRPIKLVANAITATSTRLSWNEPSSLGGRPEIWYEVKCSGRGECGTVVMTPGDKKLSTRSVQINGLRPSSDYTFLVFAKNKVSAQFPEFSEKNAVIDIRTRSEEEDVPPVSHLRVDASQSDGITIAWSVSDSDVSDFEVEVRPAIVKKRTFETRHVNMTYTTFIGLNPETVYQFRVRIRDDLRWSQPISYQLGRGLMSSPSSNEVEESQFLNQTGSALLIIIALILIVIAVALCMIVVQKKSKNRKQMSDLDVLDTYKQDSMTPDYHTTSRHHHHQGNLPATLHEQLRSTTKLNAPLIPSFGSPISQPPPYYGGVHPNSGKYKTYVDPTTYEDPYQALIEFTFDISPNDVFITQVIGGGEFGDVCLGGLSKNSPAAAKWSVSNTTMGRGGGGGGYESEPYETVAIKTLKSGSSAKAKAEFLTEATIMGQFSHPNVIRLIGVVTSAEPVMIVAEYMANGSLDQFLRNTDQRGEKVHWEKITEMLYGIASGMKYLTDMGYVHRVSFLRDLAARNVLLDMELRCKIADFGLSRGVRSEGSSVEPEYTTNGGKIPVRWTAPEAITHRKFTPSSDVWSFGVVIWEVCSFGERPYWDWTNQKVISEVMIGYRLPPPMDCPMGLYRIAQWCWKMERHERPTFTQLLATFHKYILQPTLIEHDPGELPRRVQSQSALNTYGSVNVGVVPTPPSSAAPMPSLDDFLRQIGLNHVYGQLVSNNIHSVSDLANTSHLDLLAYGLMSAECSTVRDGLNGRISGSPPGSSGTIHATTRGTRTTRPPREEGFFV

SEQ ID NO: 373 - protein, 1004 aa, Mus musculus
MAPARARLSPALWVVTAAAAATCVSAGRGEVNLLDTSTIHGDWGWLTYPAHGWDSINEVDESFRPIHTYQVCNVMSPNQNNWLRTNWVPRDGARRVYAEIKFTLRDCNSIPGVLGTCKETFNLHYLESDRDLGASTQESQFLKIDTIAADESFTGADLGVRRLKLNTEVRGVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACMACELGFYKSAPGDQLCARCPPHSHSATPAAQTCRCDLSYYRAALDPPSAACTRPPSAPVNLISSVNGTSVTLEWAPPLDPGGRSDITYNAVCRRCPWALSHCEACGSGTRFVPQQTSLAQASLLVANLLAHMNYSFWIEAVNGVSNLSPEPRSAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRTIVWICLTLITGLVVLLLLLICKKRHCGYSKAFQDSDEEKMHYQNGQAPPPVFLPLNHPPGKFPETQFSAEPHTYEEPGRAGRSFTREIEASRIHIEKIIGSGESGEVCYGRLQVPGQRDVPVAIKALKAGYTERQRQDFLSEAAIMGQFDHPNIIRLEGVVTRGRLAMIVTEYMENGSLDAFLRTHDGQFTIVQLVGMLRGVGAGMRYLSDLGYIHRDLAARNVLVDGRLVCKVSDFGLSRALEDDPEAAYTTAGGKIPIRWTAPEAIAFRTFSSASDVWSFGVVMWEVLAYGERPYWNMTNQDVISSVEEGYRLPAPMGCPRALHQLMLDCWHKDRAQRPRFAHVVSVLDALVHSPESLRATATVSRCPPPAFARSCFDLRAGGSGNGDLTVGDWLDSIRMGRYRDHFAAGGYSSLGMVLRMNAQDVRALGITLMGHQKKILGSIQTMRAQLSSTQGPRRHL

SEQ ID NO: 374 - protein, 993 aa, Mus musculus
MAGARPPPGLLPLLAPLLLPLLLPAGCWALEETLMDTKWVTSELAWTSHPESGWEEVSGYDEAMNPIRTYQVCNVRESSQNNWLRTGFIWRREVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIANAVEVSVPLKLYCNGDGEWMVPVGACTCATGHEPAAKESQCRACPPGSYKAKQGEGPCLPCPPNSRTTSPAASICTCHNNFYRADSDSADSACTTVPSPPRGVISNVNETSLILEWSEPRDLGGRDDLLYNVICKKCRGSSGAGGPATCSRCDDNVEFVPRQLGLTERRVHISHLLAHTRYTFEVQAVNGVSGKSPLPPRYAAVNITTNQAAPSEVPTLHLHSSSGSSLTLSWAPPERPNGVILDYEMKYFEKSKGIASTVTSQKNSVQLDGLQPDARYVVQVRARTVAGYGQYSHPAEFETTSERGSGAQQLQEQLPLIVGSTVAGFVFMVVVVVIALVCLRKQRHGPDAEYTEKLQQYIAPGMKVYIDPFTYEDPNEAVREFAKEIDVSCVKIEEVIGAGEFGEVCRGRLKLPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVTASAPSGMSQPLLDRTVPDYTTFTTVGDWLDAIKMGRYKESFVGAGFASFDLVAQMTAEDLLRIGVTLAGHQKKILCSIQDMRLQMNQTLPVQV

SEQ ID NO: 375 - protein, 333 aa, Homo sapiens
MAVRRDSVWKYCWGVLMVLCRTAISKSIVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFAGIASGCIIFIVIIITLVVLLLKYRRRHRKHSPQHTTTLSLSTLATPKRSGNNNGSEPSDIIIPLRTADSVFCPHYEKVSGDYGHPVYIVQEMPPQSPANIYYKV

SEQ ID NO: 376 - protein, 998 aa, Homo sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 377 - protein, 205 aa, Mus musculus
MEFLWAPLLGLCCSLAAADRHIVFWNSSNPKFREEDYTVHVQLNDYLDIICPHYEDDSVADAAMERYTLYMVEHQEYVACQPQSKDQVRWNCNRPSAKHGPEKLSEKFQRFTPFILGKEFKEGHSYYYISKPIYHQESQCLKLKVTVNGKITHNPQAHVNPQEKRLQADDPEVQVLHSIGYSAAPRLFPLVWAVLLLPLLLLQSQ

SEQ ID NO: 378 - protein, 346 aa, Homo sapiens
MARPGQRWLGKWLVAMVVWALCRLATPLAKNLEPVSWSSLNPKFLSGKGLVIYPKIGDKLDIICPRAEAGRPYEYYKLYLVRPEQAAACSTVLDPNVLVTCNRPEQEIRFTIKFQEFSPNYMGLEFKKHHDYYITSTSNGSLEGLENREGGVCRTRTMKIIMKVGQDPNAVTPEQLTTSRPSKEADNTVKMATQAPGSRGSLGDSDGKHETVNQEEKSGPGASGGSSGDPDGFFNSKVALFAAVGAGCVIFLLIIIFLTVLLLKLRKRHRKHTQQRAAALSLSTLASPKGGSGTAGTEPSDIIIPLRTTENNYCPHYEKVSGDYGHPVYIVQEMPPQSPANIYYKV

SEQ ID NO: 379 - protein, 228 aa, Homo sapiens
MLHVEMLTLVFLVLWMCVFSQDPGSKAVADRYAVYWNSSNPRFQRGDYHIDVCINDYLDVFCPHYEDSVPEDKTERYVLYMVNFDGYSACDHTSKGFKRWECNRPHSPNGPLKFSEKFQLFTPFSLGFEFRPGREYFYISSAIPDNGRRSCLKLKVFVRPTNSCMKTIGVHDRVFDVNDKVENSLEPADDTVHESAEPSRGENAAQTPRIPSRLLAILLFLLAMLLTL

SEQ ID NO: 380 - protein, 983 aa, Mus musculus
MDCHLSILVLLGCCVLSCSGELSPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCTCNAGYEERGFICQACRPGFYKASDGAAKCAKCPPHSSTQEDGSMNCRCENNYFRAEKDPPSMACARPPSAPRNVISNINETSVILDWSWPLDTGGRKDITFNIICKKCGWNVRQCEPCSPNVRFLPRQLGLTNTTVTVTDLLAHTNYTFEIDAVNGVSELSSPPRQYAAVSITTNQAAPSPVMTIKKDRTSRNSISLSWQEPEHPNGIILDYEVKYYQKQEQETSYTILRARGTNVTISSLKPDTTYVFQIRARTAAGYGTNSRKFEFETSPDSFSISGENSHVVMIAISAAVAIIVLTVVTYVLVGRFCGYHKSKHSAEEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPEMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAMSYRKFTSASDVWSYGIVLWEVMSYGERPYSQMSNQDVIKAVDERYRLPPPMDCPAALYQLMLDCWQKDRNNRPKFEQIVSILDKLIRNPGSLKIITSAAARPSNLLLDQSNVDIATFHTTGDWLNGMRTAHCKEIFTGVEYSSCDTIAKISTDDMKKVGVTVVGPQKKIISTIKALETQSKNGPVPV

SEQ ID NO: 381 - protein, 336 aa, Mus musculus; identical to SEQ ID NO: 251

SEQ ID NO: 382 - protein, 1037 aa, Homo sapiens
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 383 - protein, 1021 aa, Homo sapiens
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 384 - protein, 876 aa, Mus musculus
MRGSGPRGAGHRRTQGRGGGDDTPRVPASLAGCYSAPLKGPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDENGRSIKENQYIKIDTIAADESFTELDLGDRVMKLNTEVRDVGPLSKKGFYLAFQDVGACIALVSVRVYYKKCPSVVRHLAIFPDTITGADSSQLLEVSGSCVNHSVTDDPPKMHCSAEGEWLVPIGKCMCKAGYEEKNGTCQAPSPVTNVKKGKIAKNSISLSWQEPDRPNGIILEYEIKYFEKDQETSYTIIKSKETSITAEGLKPASVYVFQIRARTAAGYGVFSRRFEFETTPVSVAASNDQSQIPIIAVSVTVGVILLAVMIGFLLSGSCCDCGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGIAAGMKYLSDMGYVHRDLAARNILINSNLVCKVSDFGLSRVLEDDPEAAYTTRGGKIPIRWTAPEAIAFRKFTSSSDVWSYGIVMWEVVSYGERPYWEMTNQDVIKAVEEGYRLPSPMDCPAALYQLMLDCWQKDRNSRPKFDEIVNMLDKLIRNPSSLKTLVNASSRVSTLLAEHGSLGSGAYRSVGEWLEAIKMGRYTEIFMENGYSSMDAVAQVTLEDLRRLGVTLVGHQKKIMSSLQEMKVQMVNGMVPV

SEQ ID NO: 385 - protein, 998 aa, Rattus norvegicus
MVVQTRYPSWIILCYIWLLGFAHTGEAQAAKEVLLLDSKAQQTELEWISSPPSGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAVFPDTVTGSEFSSLVEVRGTCVSSAEEEAENSPRMHCSAEGEWLVPIGKCICKAGYQQKGDTCEPCGRRFYKSSSQDLQCSRCPTHSFSDREGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTLKTKSTSASINNLKPGTVYVFQIRAFTAAGYGNYSPRLDVATLEEASGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPSSLKTPLGTCSRPISPLLDQSTPDFTAFCSVGEWLQAIKMERYKDNFTAAGYNSLESVARMTIDDVMSLGITLVGHQKKIMSSIQTMRAQMLHLHGTGIQV

SEQ ID NO: 386 - protein, 984 aa, Rattus norvegicus
MALDCLLLFLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKAGYEPENSVACKACPAGTFKASQEAEGCSHCPSNSRSPSEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLSEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGVTLAGHQKKILSSIHSMRVQMNQSPSVMA

SEQ ID NO: 387 - protein, 986 aa, Gallus gallus
MAGVPVGALLPLLVGVCGAVTGSRVYPANEVTLLDSRSVQGELGWIASPLEGGWEEVSIMDEKNTPIRTYQVCNVMEPSQNNWLRTDWIPREGAQRVYIEIKFTLRDCNSLPGVMGTCKETFNLYYYESNNDKERFIRESQFAKIDTIAADESFTQVDIGDRIMKLNTEVRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGYEERNGECQACKIGYYKALSTDVACAKCPPHSYSIWEGSTSCTCDRGFFRAENDAASMPCTRPPSAPQNLISNVNETSVNLEWSAPQNKGGRDDISYNVVCKRCGAGEPSHCRSCGSGVHFSPQQNGLKTTKVSITDLLAHTNYTFEVWAVNGVSKHNPSQDQAVSVTVTTNQAAPSPIALIQAKEITRHSVALAWLEPDRPNGVILEYEVKYYEKDQNERSYRIVKTASRNTDIKGLNPLTSYVFHVRARTAAGYGDFSGPFEFTTNTVPSPIIGDGTNPTVLLVSVAGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPSTALLDPSSPEFSAVVSVSDWLQAIKMERYKDNFTAAGYTTLEAVVHMNQDDLARIGITAITHQNKILSSVQAMRSQMQQMHGRMVPV

SEQ ID NO: 388 - protein, 1005 aa, Rattus norvegicus
MRGSGPRGAGRRRTQGRGGGGDTPRVPASLAGCYSAPLKGPLWTCLLLCAALRTLLASPSNEVNLLDSRTVLGDLGWIAFPKNGWEEIGEVDENYAPIHTYQVCKVMEQNQNNWLLTSWISNEGASRIFIELKFTLRDCNSLPGGLGTCKETFNMYYFESDDENGRNIKDNQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDDPPKMHCSAEGEWLVPIGKCMCKAGYEEKNGTCQVCRPGFFKASPHSQTCSKCPPHSYTHEEASTSCVCEKDYFRRESDPPTMACTRPPSAPRNAISNVNETSVFLEWIPPADTGGGKDVSYYILCKKCNSHAGVCEECGGHVRYLPQQIGLKNTSVMMADPLAHTNYTFEIEAVNGVSDLSPGTRQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFGASNDQSQIPIIGVSVTVGVILLAVMIGFLLSGSCCECGCGRASSLCAVAHPSLIWRCGYSKAKQDPEEEKMHFHNGHIKLPGVRTYIDPHTYEDPTQAVHEFGKEIEASCITIERVIGAGEFGEVCSGRLKLPGKRELPVATKTLKVGYTEKQRRDFLSEASIMGQFDHPNIIHLEGVVTKSKPVMIVTEYMENGSLDTFLKKNDGQFTVIQLVGMLRGIAAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKDRNSRPKFDDIVNMLDKLIRNPSSLKTLVNASSRVSTLLAEHGSLGSGAYRSVGEWLEATKMGRYTEIFMENGYSSMDAVAQVTLE

SEQ ID NO: 389 - protein, 1005 aa, Homo sapiens
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRTIVWICLTLITGLVVLLLLLICKKRHCGYSKAFQDSDEEKMHYQNGQAPPPVFLPLHHPPGKLPEPQFYAEPHTYEEPGRAGRSFTREIEASRIHIEKIIGSGDSGEVCYGRLRVPGQRDVPVAIKALKAGYTERQRRDFLSEASIMGQFDHPNIIRLEGVVTRGRLAMIVTEYMENGSLDTFLRTHDGQFTIMQLVGMLRGVGAGMRYLSDLGYVHRDLAARNVLVDSNLVCKVSDFGLSRVLEDDPDAAYTTTGGKIPIRWTAPEAIAFRTFSSASDVWSFGVVMWEVLAYGERPYWNMTNRDVISSVEEGYRLPAPMGCPHALHQLMLDCWHKDRAQRPRFSQIVSVLDALIRSPESLRATATVSRCPPPAFVRSCFDLRGGSGGGGGLTVGDWLDSIRMGRYRDHFAAGGYSSLGMVLRMNAQDVRALGITLMGHQKKILGSIQTMRAQLTSTQGPRRHL

SEQ ID NO: 390 - protein, 345 aa, Mus musculus
MARPGQRWLSKWLVAMVVLTLCRLATPLAKNLEPVSWSSLNPKFLSGKGLVIYPKIGDKLDIICPRAEAGRPYEYYKLYLVRPEQAAACSTVLDPNVLVTCNKPHQEIRFTIKFQEFSPNYMGLEFKKYHDYYITSTSNGSLEGLENREGGVCRTRTMKIVMKVGQDPNAVTPEQLTTSRPSKESDNTVKTATQAPGRGSQGDSDGKHETVNQEEKSGPGAGGGGSGDSDSFFNSKVALFAAVGAGCVIFLLIIIFLTVLLLKLRKRHRKHTQQRAAALSLSTLASPKGGSGTAGTEPSDIIIPLRTTENNYCPHYEKVSGDYGHPVYIVQEMPPQSPANIYYKV

SEQ ID NO: 391 - protein, 977 aa, Mus musculus
MERRWPLGLALLLLLLCAPLPPGARAEEVTLMDTSTAQGELGWLLDPPETGWSEVQQMLNGTPLYMYQDCPIQEGGDTDHWLRSNWIYRGEEASRIYVELQFTVRDCKSFPGGAGPLGCKETFNLFYMESDQDVGIQLRRPLFQKVTTVAADQSFTIRDLASGSVKLNVERCSLGHLTRRGLYLAFHNPGSCVALVSVRVFYQRCAETVHGLAHFPDTLPGPGGLVEVAGTCLSHAQISLGSSGTPRMHCSPDGEWLVPVGQCQCEPGYEESSGNVGCTACPTGFYRVDMNTLRCLKCPQHSIAESEGSTICTCENGHYRAPGEGPQVACTRPPSAPQNLSFSTSGTQLSLRWEPPRDTGGRHDIRYSVECLQCRGIAQDGGPCQPCGKGVHFSPAASGLTTSTVQVQGLEPYANYTFTVKSQNRVSGLDSSSPSSASLSINMGHAESLSGLSLKLVKKEPRQLELTWAGSRPRNPGGNLSYELHVLNQDEEWHQMVLEPRVLLTKLQPDTTYIVRVRTLTPLGPGPFSPDHEFRTSPPVSRSLTGGEIVAVIFGLLLGIALLIGIYVFRSRRGQRQRQQRQRERTTNVDREDKLWLKPYVDLQAYEDPAQGALDFAQELDPAWLIVDTVIGEGEFGEVYRGALRLPSQDCKTVAIKTLKDTSPDGYWWNFLREATIMGQFNHPHILRLEGVITKRKPIMIITEFMENGALDAFLKEREDQLAPGQLVAMLLGIASGMNCLSGHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFLQLQAHLEQLLTDPHSLRTIANFDPRVTLRLPSLSGSDGIPYRSVSEWLESIRMKRYILHFRSAGLDTMECVLELTAEDLTQMGITLPGHQKRILCSIQGFKD

SEQ ID NO: 392 - protein, 340 aa, Homo sapiens
MGPPHSGPGGVRVGALLLLGVLGLVSGLSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMPAVAGAAGGLALLLLGVAGAGGAMCWRRRRAKPSESRHPGPGSFGRGGSLGLGGGGGMGPREAEPGELGIALRGGGAADPPFCPHYEKVSGDYGHPVYIVQDGPPQSPPNIYYKV

SEQ ID NO: 393 - protein, 205 aa, Rattus norvegicus
MEFLWAPLLGLCCSLAAADRHIVFWNSSNPKFREEDYTVHVQLNDYLDIICPHYEDDSVADAAMERYTLYMVEHQEYVTCEPQSKDQVRWKCNQPSAKHGPEKLSEKFQRFTPFTLGKEFKEGHSYYYISKPIYHQETQCLKLKVTVNGKITHSPHAHANPQEKRLQADDPEVQVLHSIGHSAAPRLFPLVWAVLLLPLLLLQTQ

SEQ ID NO: 394 - protein, 652 aa, Drosophila melanogaster
MQERSKQLRLTVSWTQSKSQIHDSCQRRSMLACKRRLTTSKVLEDSHPPVAFPNCKSHRHQQQKEKHKVQLYSGKPLSIKLYVPGSIESIPKIRHKALTTTNKQQPAMHRKSKSKSKFQGFNNLKPLYSPSKRQPPEKHSSVLVEAGIESKASRHFVGKKRIKNRNCLLSSPQPSPMRCKMMIPFPKFGATSFVTLLTLICMETVLLSTMSSCAKTFYMHWNTSNSIFRIDNTDHIIDVNKGNLAFEFDQVHIICPVYEPGTFENETEKYIIYNVSKVEYETCRITNADPRVIAICDKPQKLMFFTITFRPFTPQPGGLEFLPGNDYYFISTSSKDDLYRRIGGRCSTNNMKVVFKVCCAPEDNNKTTALSNSKSVTDTGGAINVNIANNDESHVNSHGNNIAIGTNIGINGGQIIGGPQSAGIPINPLSGNNNINGIPTTINSNIDQFNRIPIQPNIIGNHVGTNAVGTGIVGGGGIILTPGHAHGNINMLQPGRGGINGAYPGHHHIQTGIRINNVPTQHNYPSHKGNANSNINGNDDHHHYNKHPNEVVKNEELTYNSGAATSDGNIFALWIWILSIFPLLSIQSCHLSSYWISASFLVSTIAILGIHYLIQITLQTTVQRYSPGMVEITATSMNGMFDQNAGTIEYDR

SEQ ID NO: 395 - protein, 5147 aa, Drosophila melanogaster [sequence omitted]

SEQ ID NO: 396 - protein, 4699 aa, Drosophila melanogaster
MFTMKIKKYVTPVKRKAFTILQWISLLCSLWLIPTVQSKADEKHTATLEYRLENQLQDLYRFSHSVYNVTIPENSLGKTYAKGVLHERLAGLRVGLNAEVKYRIISGDKEKLFKAEEKLVGDFAFLAIRTRTNNVVLNREKTEEYVIRVKAHVHLHDRNVSSYETEANIHIKVLDRNDLSPLFYPTQYTVVIPEDTPKYQSILKVTADDADLGINGEIYYSLLMDSEYFAIHPTTGEITLLQQLQYAENSHFELTVVAYDRGSWVNHQNHQASKTKVSISVKQVNFYAPEIFTKTFSSVTPTSNPLIYGIVRVNDKDTGINGNIGRLEIVDGNPDGTFLLKAAETKDEYYIELNQFAHLNQQHFIYNLTLLAEDLGTPRRFAYKSVPIQIKPESKNIPIFTQEIYEVSIPETAPINMPVIRLKVSDPDLGKNALVYLEIVGGNEGDEFRINPDSGMLYTAKQLDAEKKSSYTLTVSAIDQANVGSRKQSSAKVKISVQDMNDNDPIFENVNKVISINENNLAGSFVVKLTAKDRDSGENSYISYSIANLNAVPFEIDHFSGIVKTTSLLDFETMKRNYELIIRASDWGLPYRRQTEIKLSIVVKDINDNRPQFERVNCYGKVTKSAPMGTEVFVTSAIDFDAGDIISYRLSDGNEDGCFNLDPTSGSLSISCDLKKTTLTNRILKVSATDGTHFSDDLIINVHLMPEDLGGDSSILHGFGSFECRETGVARRLAETLSLAEKNNVKSASPSVFSDLSLTPSRYGQNVHRPEFVNFPQELSINESVQLGETVAWIEAKDRDLGYNGKLVFAISDGDYDSVFRIDPDRGELQIIGYLDRERQNEYVLNITVYDLGNPTKSTSKMLPITILDVNDNRPVIQKTLATFRLTESARIGTVVHCLHATDADSGINAQVTYALSVECSDFTVNATTGCLRLNKPLDREKQDNYALHITAKDGGSPVLSSEALVYVLVDDVNDNAPVFGVQEYIFKVREDLPRGTVLAVIEAVDEDIGPNAEIQFSLKEETQDEELFRIDKHTGAIRTQGYLDYENKQVHNLIVSAIDGGDPSLTSDMSIVIMIIDVNENRFAPEFDDFVYEGKVKENKPKGTFVMNVTARDMDTVDLNSKITYSITGGDGLGIFAVNDQGSITSLSQLDAETKNFYWLTLCAQDCAIVPLSNCVEVYIQVENENDNIPLTDKPVYYVNVTEASVENVEIITLKAFDPDIDPTQTITYNIVSGNLVGYFEIDSKTGVIKTTERKLDRENQAEHILEVAISDNGSPVLSSTSRIVVSVLDINDNSPEFDQRVYKVQVPSSATVNQSIFQVHAIDSDSGENGRITYSIKSGKGKNKFRIDSQRGHIHIAKPLDSDNEFEIHIKAEDNGIPKKSQTARVNIVVVPVNPNSQNAPLIVRKTSENVVDLTENDKPGFLVTQILAVDDDNDQLWYNISNGNDDNTFYIGQDNGNILLSKYLDYETQQSYNLTISVTDGTFTAFTNLLVQVIDINDNPPQFAKDVYHVNISENIEEESVIMQLHATDRDEDKKLFYHLHATQDPSSLALFRIDSISGNVIVTQRLDFEKTAQHILIVFVKDQGAPGKRNYAKIIVNVHDHNDHHPEFTAKIIQSKVPESAAIGSKLAEVRAIDRDSGHNAEIQYSIITGNVGSVFEIDPTFGIITLAGNLNINKIQEYMLQVKAVDLGNPPLSSQIPVHIIVTMSENDPPKFPTNNIAIEIFENLPIGTFVTQVTARSSSSIFFNIISGNINESFRINPSTGVIVINGNIDYESIKVFNLTVKGTNMAAESSCQNIIIHILDANDNIPYFVQNEYVGALPESAAIGSYVLKVHDSSKDHLTLQVKDADVGVNGMVEYHIVDDLAKNFFKIDSTTGAIELLRQLDYETNAGYTFDVTVSDMGKPKLHSTTTAHVTIRVINVNDCPPVFNERELNVTLFLPTFENVFVRQVSAKDADNDTLRFDIVDGNTNECFQIEKYTGIITTRNFEILNNENDRDYALHVRASDGIFSAILIVKIKVLSAIDSNFAFQRESYRFSAFENNTKVATIGLVNVIGNTLDENVEYRILNPTQLFDIGISSGALKTTGVIFDREVKDLYRLFVEAKSMLYDGMNSNVRRAVTSIDISVLDVNDNCPLFVNMPYYATVSIDDPKGTIIMQVKAIDLDSAENGEVRYELKKGNGELFKLDRKSGELSIKQHVEGHNRNYELTVAAYDGAITPCSSEAPLQVKVIDRSMPVFEKQFYTVSVKEDVEMYSALSVSIEAESPLGRSLIYTISSESQSFEIDYNTGSIFVVNELDYEKISSHDVSIRATDSLSGVYAEVVLSVSIMDVNDCYPEIESDIYNLTIPENASFGTQILKINATDNDSGANAKLSYYIESINGQNNSELFYIDVTDGNLYLKTPLDYEQIKYHHIVVNVKDHGSPSLSSRSNVFITVKDLNDNAPCFVEPSYFTKVSVAAVRGQFVALPKAYDKDISDTDSLEYKIVYGNELQTYSIDKLTGVISLQNMLNFTDKSSTVLNISVSDGVHTAYARLKISLLPENVYSPLFDQSTYEAQVPENLLHGHNIITVKASDGDFGTYANLYYEIVSEEMKKIFLIDQTTGVITSKVTFDREKKDEYVVLLKVSDGGGKFGFASLKVIVVDVNDNVPYFLLKEYKMVVSTTVEANQTILTVKAKDDDIVDNGSVHFQIVQKSNDKAVKDVIEINEKTGDIVFKSKAESYGVNSYQFFVRASDRGEPQFHSEVPVSIEIIETDANIPTFEKSSVLLKIIESTPPGTVLTKLHMIGNYTFKFSIAADQDHFMISDSGELILQQTLDREQQESHNLIVVAETSTVPVFFAYADVLIDVRDENDNYPKFDNTFYSASVAENSEKVISLVKVSATDADTGPNGDIRYYLESDTENIQNIFDIDIYSGWITLLTSLDREVQSEYNFKVIAADNGHPKHDAKVPVTIKIVDYNDNAPVFKLPIEGLSVFENALPGTVLINLLLIDPDIEKQEMDFFIVSGDKQAQFQIGKSGELFIAKPLDREQLMFYNLSIIATDGKFTAKANVEIDVKDINDNTPYCLKPRYHISTNESISIGTTLVEVKAIDFDFQSKLRFYLSGKGADDFSIGKESGILKVASALDRETTPKYKLVAHVQDGKDFTQECFSEIIITVNDINDNMPIFSMAQYRVSVPEDAQLNTLITKVHAMDKDFGVNRQIKYSLMGENHDYFKISKSTGIIRLHKSLDRETISLFNLTVKAEDCGVPKLHSIATVAVNILDINDNPPEFSMRQYSCKILENATHGTEVCKVYATSIDIGVNADIHYFIMSGNEQGKFKMDSTTGDLVLNATLDYEMSKFYFLTIQAIDGGTPPLSNNAYVNISILDINDNSPTFLQNLYRINVNEDIFVGSKILDVKATDEDSDVNGLVTYNIERGDNIGQFSIDPKNGTISVSRPLDRETISHYTLEIQACDQGDPQRCNSVPININILDTNDNAPIFSSSNYSVVLQENRLLGYVFLTFKISDADETPNTTPYTFDIRSGNEGGLFRLEQDGSLRTASRFNHNLQDEFVIQVRVFDNGTPPLYSDAWVVVKIIEESQYPPIVTPLEVTINSFEDDFSGAFIGKVHASDQDKYDELNFSLVSGPDDMYQSSKLFNISNNTGKIYAISNLDIGLYKLNVSVSDGKFHVFSIVKINVELVTNDMLKESVVIRFRRISASEFLLSHRKTFMRSIRNIMRCRQKDVILITLQSDYQKASQHAVGNRRARSIDSDLNVVFAVRKQQIIPDSDEFFTSDEIRQTLIDKKNEIENETNLVVEDVLPSTCQSNKNDCVHGECKQILQILKNNVTTTFTDVISFAAPSYIPVNTCVCRPGFDGKHCKETVNACSTDPCSPQRICMPSGSALGYQCVCPKGFSGTYCERKSSKCSNESCDMGLFTAVSFGGKSYAHYKINKVKAKFTLENGFSYSLQIRTVQQTGTLLYASGKVDYNILEIINGAVQYRFDLGSGEGVISVSSINISDGEWHQISLERSLNSAKVMVDNKHVSHGSAPGVNGILNIQSNDIFVGAEVRPHPSIIGYEDIQRGFIGCMANIKIAKESLPLYISGGSTIAALKRFTNVEFKCDPSNVLVRLGICGSQPCANSGICKELDTDVFECACQPRYSGKHCEIDLDPCSSGPCLFGGRCDYHGPNNYSCTCPIHLSGKRCEYGKFCTPNPCKNGGICEEGDGISHCMCRGYTGPTCEIDVDECENQPCGNGATCINEPGSFRCICPSYLTGASCGDPLYSNSISTKLKNFSIEHISGIISGVAVVLVIISCVLCCVVLKRSSSSKRRNRLEKDKNKSSYKEANLNSLVDKDNYCKPNVKLSNLEVNQRPISYTAVPNDNLVLSNRNFVNNLDILRSYGSAGDELENVPFEYQKVNRNKQHVNINSCHSTDADNAYKQEWCEQMHLRTFSENKLNNELKRDFGPSVSRFSTGKLIQVEMPNVCHSSSANFVDYSALANGQYHWDCSDWVRKSHNPLPDITEVPGAEIADSSSLHSNDSNESKSKKAFFVHREDGDVDPTRDIAALNEDIGSEYLDSEAESCLEPFMLPRSSNQPLSRLSSFNNIENEDYKSNTVPLPSKVSHSCKVYLRHPDSYLPTMHFPSETDGESSMTEGPISRMEIKTRRTISENSEEAYLFPCTVGEIGSNSNISVRLCEIEDSELEEFLPQQQTNN

SEQ ID NO: 397 - protein, 4981 aa, Mus musculus
MNLAANRAPGRRRLPLPSPSLCQLLRVWGLLSLLPGSARVQAAEQRQVFQVMEEQPPGTLVGTIPTRPGFTYRLSESHALFAINSSTGALYTTATIDRESLPSDVVNLVVLSSSPTYPTEVRVLVRDLNDNAPVFPDPSIVVTFKEDSGSGRQVILDTATDSDIGSNGVDHHSYRIVSGNEAGRFRLDITLNPSGEGAFLHLVSKGGLDREVTPQYQLLVEVEDKGEPKRRGYLQVNVTVQDINDNPPVFGSSHYQAGVPEDAVVGSSVLQVAAADADEGTNADIRYRLQDEGTPFQMDPETGLITVREPLDFEARRQYSLTVQATDRGVPSLTGRAEAFIQLLDVNDNDPVVKFRYFPATSRYASVDENAQVGTVVALLTVTDADSPAANGNISVQILGGNEQRHFEVQRSKVPNLSLIKVASALDRERIPSYNLTVSVSDNSGAPPTAEVQARSSVASLVIFVNDINDHPPVFEQQVYRVNLSEEVPPGSYVSGVSATDGDSGLNANLRYSIVSGNGLGWFHISEHSGLVTTSAAGGLDRELASQIVLNISARDQGVHPKVSYAQLVVTVLDVNDEKPVFSQPEGYEVSVVENAPTGTELLVLGATDRDLGDNGTVRFSLQEAENDQRLFRLDPVSGRLSTASSLDREEQAFYCLSILATDLGSPPQSSTAQVNVSLLDINDNSPVFYPVQYFAHIQENEPGGSYVTTVSATDPDMGPNGTVKYSISAGDRSRFQIHAKSGVISTKMALDREEKTAYQLQVVATDGGNLQSPNQAIVTVTVLDTQDNPPVFSQAAYSFVVFENVALGYHVGSVSATTMDLNANISYLITTGDQRGMFAMNPVTGQLTTASVIDREEQSFYQLKIVASGGAVTGDTVVNITVKDLNDNAPHFLQAVESINAVENWQAGHSIFQAKAVDPDEGVNGRVLYSLKQNPKNLFTINEQNGNISLLGALDVHAGSYQVEIVASDMGVPQLSSSILLTVYVHDVNDNPPVFDQISYEVTLSESEPVNSRFFKVQASDKDSGANGEIAYTITDGNNGDAFGIFPDGQLYIKSELDRELQDRYVLLVVASDRAVEPLSATVNVTVLLEDVNDNRPLFNSTNYTFYFEEEQRAGSFVGKVSAVDKDFGPNGEVRYAFEVTQPNFELHAVTGEITSTHKFDRESLMRRRGTAVFSFTVTAMDRGLPQPLKDQATVHVYMKDINDNAPKFLKDFYQATVSETATNLTQVLRVSASDVDEGSNGLIHYSILKGNEERQFAIDSFSGQVTLVGKLDYEATSAYSLLIQAVDSGAIPLNSTCTLSIDILDENDNTPSFPKSTLFVDVLENMRIGELVSSVTATDSDSGVNADLHYTITGSNNHGTFSISPNTGSIFLAKKLDFETQSLYKLNITAKDQGRPPRSSTMSVVIQVRDFNDNPPSFPPGDIFKSIVENIPLGTSVISVTAHDPDADINGQLSYAIIQQMPRGNHFSIDEVKGTIYTSAEIDREFANLFELTVKANDQAVPIETRRYALKNVTILVTDLNDNVPMFISQNALAADPSAMIGSVLTTIMAADPDEGANGEVEYEILNGDTDTFTVDRYSGDLRVASALVPSQLIYNLIVSATDLGPERRKSTTELTVILQGLDGPVFTQTKYITILKEGEPIGTNVISIEAASPRGSEAPVEYYIVSVRCEEKTVGRLFTIGRQTGVIQTAAILDREQGACLYLVDVYAIEKSSAFPRTQRAEVEITLQDINDNPPVFPTDTLDLTVEENIGDGSKIMQLTAMDADEGANALVTYALISGADDSFRIDPESGDLIATKRLDREHRSKYSLLVRADDGLQSSDMRINITISDVNDHTPRFSRPVYSFDIPEDTTPGSLVAAILATDDDSGVNGEISYVVEEDDGDGVFFLNLVTGVFNLTRALDYETQQYYILTVRAEDGGGQSTTIRAYFNILDVNDNPPVFSMSSYSTSLMENLPLGSTVLVFNVTDADDGVNSQLSYSIASGDSLGQFAVDKHGVLKTLKALDRESQSFYNLVIQVHDLPQPPTSRFTSTAQVSIILLDVNDNPPMFLSPKLTYIPENTPIDTVVFKAQATDPDSGPNSYIEYTLLNPSGNKFSIGTIDGEVHLTGELDREEVSNYSLTVVATDKGQPPLSSSTEVVVMVLDINDNNPVFAQAMYRVQIKENILTGTDIIQVSAADNDEGTNGQVRYGIVGGNTHQEFRIDSVTGAITVAKSLDRETTPAYTLTVQATDRGSSPRTDSCTVAITLLDMNDFVPVFELSPYSVNVPENLGTLPRAILQVVARDDDQGPNSQLSYVLLGGNEDNAFVLTASGELRVTQSLDREARDHFVLVVTAADAGSPALTGTGTINIIVDDINDNVPTFANNMYLTSIAEDARTGTDVLLVNASDADAAANAVISYSIIGGNSQFTINPSTGQIITSALLDRETKDNYTLVVVASDAGSPESLSSSTSVLVTITDVNDNPPRFQHHPYVTHIPSPTPPGSFVFAVTVTDADIGSNSELHYSLSGRNSEKFHIDPLRGAIMAAGPLSGASEVTFSVHVKDGGSFPKTDSTTVTVRFANKADFPKVRAKEQTFMFPENQPVGTLVTTITGSSLRGETLSYYIASGNLGDTFQIDPLTGQVSISQPLDFEKIQKYVVWIEARDGGFPPFSSYEKLDITVLDINDNAPTFEEDPFVSEILENLSPRKILTVSATDKDSGPNGQLDYEIVNGNQESSFTINHATGEIRSIRPLDREKISHYELTVKSSDKGSPSQSTSVKVIISILDENDNAPRFSQIFSAYVSENSPLGYTVTRVTTSDEDIGINAISRYSIVDTSLPFTINPNTGDIVISRPLNREDTDRYRIRVSAHDSGWTVSTDVTIFVTDINDNTPRFSRPSYYLDCPELPELGSRVTQVSATDPDEGSNGQVFYFIKSQSEYFRINATTGEIFNKQVLKYQNVSGFSNVNINRHSFIVTASDRGNPSLLSETTVTINTVDSNDNPPQFLQNKYFTPVTKNVKVGTKLIKVTAVDDKDFGLNSEVEYFVSDGNHLGKFKLDNDTGWISIASSLVSDLNQNFLIRVTAKDKGNPPLSSQAVVHITVTEENYHTPEFSQNHISATIPESHSIGSVVRTVSARDRDTAMNGLISYNIISGNEEGIFAINSSTGVVTLAKALDYEMSSKHEMTISATDGGWVARTGYCSLTVSVIDVNDNSPVFVPDEFFPTVMENAPSGTTVIHLNATDADSGANAVIAYTVQSSDSDLFVIDPNMGVITTQGFLDFETKQSYHLTVKAFNVPDEEKCSFATVDIQLKGTNEYVPRFVSKLYYFEVSEAASRGTAVGEVFASDRDMGADGEVHYLIFGNSRKKGFQINKMTGQIYVSGLLDREKEERVSLKVLAKNFGNIRGADIDEVTVNITVLDANDPPVFSLSTYRVQISEGVPIGTHVTFVSAFDSDSIPSWSRFSYFIGSGNENGAFSINPQTGQITVTSGLDRESLPVYNLTVLAVDSGTPSATGSASLVVTLEDINDNGPVLTVSEGEVLENKRPGTLVMTLQSTDPDLPPNQGPFNYYLLSTGPATNYFSLSTAGVLSTTREIDREQIADFYLSVVTRDSGAPQMSSTGTVHITVLDQNDNPSQSRTVEIFVNYYGNLFPGGTLGSVKPQDPDVLDSFHCSLTSGVTSLFSIPAGSCDLSSQPRSTDGTFDLTVVSSDGVHSTVTNNIRVFFAGFSNATIDNSILLRVGVPTVKDFLTNHYLHFLRIASSQLTGLGTAVQLYAAYEENNRTFLLAAVKRNNNQYVNPSGVATFFESIKEILLRQSGVKVESVDHDPCIHGPCQNGGSCLRRLAVGSALKIQESLPVIIVANEPLQPSQCKCVPGYAGSWCEVDIDECLPAPCHNGGTCHNLVGGFSCSCPEGFTGRACERDINECLPSPCKHGAVCQNFPGGFNCVCKTGYTGKMCESSVNYCECNPCFNGGSCQSGVESYYCHCPFGVFGKHCELNSYGFEELSYMEFPSLDPNNNYIYVKFATIKSHALLLYNYDNQTGERAEFLALEIAEERLRFSYNLGSGTYKLTTMKKVSDGQFHTVIARRAGMAASLTVDSCSENQEPGYCTVSNVAVSDDWTLDVQPNRVTVGGIRSLEPILQRRGHVESHDFVGCVMEFAVNGRPLEPSQALAAQGILDQCPRLEGTCARNPCQHGGTCVDFWSWQQCQCMEGLTGKYCEKSVTPDTALSLEGKGRLDYHMSQSEKREYLLTQSIRDTTLEPFGVNSLEVKFRTRSENGILIHIQESSNYTTVKIKNGKVHFTSDAGVAGKVERIIPEAYIADGHWHTFRISKNGSITVLSVDRIHNRDIVHPTQDFGGIEVLSMSLGGIPPNQAHRDTQTGFNGCIASVLYGGESLPFSGKHSLASISKTDPSVKIGCRGPNICASNPCWGDLLCINQWYAYKCVPPGDCASHPCQNGGSCEPGLLSGYTCSCPESHTGRTCETVVACLGVLCPQGKVCKAGSPGGHVCVQSQGPDEISLPLWAVPAIVGSCATALALLVLSLILCNQCRGKMPKNPKEEKKPKEKKKKGSENVAFDDPDNIPPYGDDLAVRKQPEGNPKPDIIERENPYLIFDETDIPHNSETIPSAPLASPEQEIEHYDIDNASSIAPSDADIIQHYKQFRSHTPKFSIQRHSPLGFARQSPMPLGASSLTYQPSSYGQGLRTSSLSHSACPTPNPLSRHSPAPFSKPSAFYRNSPARELHLPLRDGGTLEMHGDPCQPGMFNYATRLGRRSKSPQAMASHGSRPGSRLKQPIAQIPLESSPPVGLSIEEVERLNTPRPRNPSICSADHGRSSSEEDCRRPLSRTRNPADGIPAPESSSDSDSHDSFTCSEMEYDREKPVVYTSRMPKLSQVNESDADDEDNYGARLKPRRYHGRRAEGGPVGTPAAASGAADSTLKLGQQAGNFNWDNLLNWGPGFGHYVDVFKDLASLPEKAAGNEEGKSGAAKPAAKDGEAEQYV

SEQ ID NO: 398 - protein, 4588 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 399 - protein, 4555 aa, Mus musculus
MSVTMGHCMGTKPPSCIILLLLKLFATVSQGLPGTGPLGFHFTHSTYNATVYENSAARTYVNSQSRMGITLIDLSWDIKYRIVSGDEEGFFKAEEVIIADFCFLRIRTKGGNSAILNREIQDNYLLIIKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPIIHVVSHTPFSLDKEPTYAVVTVDDLDEGANGEIESLSIVDGDPLEQFFLAKEGKWLNEYKVKERRQVDWESFSYGYNLTIQAKDKGSPQKFSELKTVHIANPRRDNTPVRFEKDVYEVSISEFSPPGVLVAIVKVSPEPLDVEYKLLPGKDSDYFKINPRSGLIVTAQPLNTVKKEVYKLEVSDKEGDAKAQVTIGIEDANDHTPEFQEALYETFVNESVRVGTNVLTVSASDKDKGENGYITYSIASLNLLPFAINQFTGVISTTEELDFESSPETYRFIVRASDWGSPYRHESEVNVTIRVGNVNDNSPLFEKVACQGVISYDFPVGGHITAISAIDIDELELVKYKIISGNELGFFYLNPDSGVLQLKKSLMNSGIKNGNFALRITATDGENFADPMAINISVLHGKVSSKSFSCRETRVAQKLAEKLLIKAKANGKLNLEDGFLDFYSINRQGPHFDKSFPSDVAVKEDMLVGTNILKIKAYDADSGFNGKVLFTISDGNTDSCFNIDMETGQLKVLMPMDREHTDLYVLNITIYDLGKPQKSSWRLLTVNVEDANDNNPVFLQDSYSVSILESSSIGTEIIQVEARDKDLGSNGEVMYSVLTDTHQFIINSSTGIVYIADQLDRESKANYSLKIEARDKAESGQQLFSVVTLKIFLDDVNDCSPAFIPSSYSVKVLEDLPVGTVIAWLETQDPDLGLGGQVRYSLVNDYNGRFEVDKASGAIRLSKELDYEKQQFYNLTVRAKDKGRPVSLSSVSFVEVEVVDVNENLHTPYFPDFAVVGSVKENSRIGTSVLQVTAHDEDSGRDGEIQYSIRDGSGLGRFNIDDESGVITAADSLDRETTASYWLTVYATDRGVVPLYSTIEVYIEVEDVNDNAPLTSEPIYYPVVMENSPKDVSVIQIQAEDPDSGSNEKLTYRITSGNPQNFFAINIKTGLITTTSRKLDREQQAEHFLEVTVTDGGSSPKQSTIWVVVQVLDENDNRPQFPEKVYQIKLPERDRKKRGEPIYRAFAFDKDEGPNAEISYSIVDGNDDGKFFIDPKTGMVSSRKQFTAGSYDILTIKAVDNGRPQKSSTARLHIEWIKKPPPSPIPLTFDEPFYNFTVMESDKVTEIVGVVSVQPANTPLWFDIVGGNFDSSFDAEKGVGTIVIAKPLDAEQRSVYNMSVEVTDGTNIAVTQVFIKVLDNNDNGPEFSQPHYDVTISEDVLPDTEILQIEATDRDEKHKLSYTIHSSIDAVSMRKFRMDPSTGVLYTAERLDHEAQDKHILNIMVRDQEFPYRRNLARVIVNVEDANDHSPYFTNPLYEASVFESAALGSVVLQVTALDKDKGENAELIYSIEAGNTGNTFKIEPVLGIITISKEPDMAAMGQFVLSVKVTDQGSPPMSATAIVRISISMSDNSHPKFTHKDYQAEVNENVDIGTSVILISAISQSTLIYEVKDGNINGVFTINPYSGVITTRRALDYEHTSSYQLIIQATNMAGMASNATISVQIVDENDNPPVFLFSQYSGSLSEAAPINSIVRSLDNSPLVIRATDADSNQNALLVYQIVESTAKKFFTVDSSTGAIRTIANLDHEAIAHFHFHVHVRDSGNPQLTAESPVEVNIEVTDVNDNPPVFTQAVFETVLLLPTYIGVEVLKVSATDPDSEVPPELTYSLMEGSVDNFLMDPNTGVLTIKNNNLSKDHYMLIVRVSDGKFYSTAMVTVMVKEAMDSGLHFTQSFYSTSISENSTNITKVAIVNAVGNRLNEPLKYSILNPGNKFKIKSTSGVIQTTGVPFDREEQELYELVVEASRELDHLRVARVVVRVNIEDVNDNSPVFVGLPYYAAVQVDAEPGTLIYRVTAIDKDKGANGEVTYVLQDDYGHFEINPNSGNVILREAFNSDLSNIDYGVTILAKDGGNPSLSTFVELPITIVNKAMPVFDKPFYTASINEDITMNTPILSINATSPEGQGIIYLIIDGDPFQQFNIDFDTGVLKVISPLDYEVTSVYKLTVRASDALTGARAEVTVDLLVDDINDNPPVFDQPTYNTTLSESSLIGTPVLQLVSTDADSGNNKLVRYQIVQDTYNSTDYFHIDSSSGLILTARMLDHELVQHCTLKVTATDNGFPSLSSEVLVQIYISDVNDNPPVFNQLIYESYVSELAPRGHFVTCVQASDADSSDLDRLEYSILSGNDRASFLMDSKSGVLTLSSHRKQRMEPLYSLNVSVSDGLFTSTAQVHIRVLGANLYSPAFSQSTYVAEVRENAASGTKVIHVRATDGDPGTYGQVSYSIINDFAKDRFLIDSNGQIITTERLDRENPLEGDISIYLRALDGGGRTTFCTVRVIVVDENDNAPQFMTVEYRASVRADVGRGHLVTQVQALDPDDGANSRITYSLYSEASVSVADLLEIDPDNGWMVTKGNFNQLRNTVLSFFVKAVDGGIPVRHSLIPVYIHVLPPETFLPSFTQSQYSFTITEDTSIGSTVDTLRILPNQSVRFSMVNGERPENNKEGVFIIEQETGAIKLDKRLDHEVSPAFHFKVAATIPLDKVDIVFTVDVDVKVLDLNDNKPVFETSTYETIIMEGMPVGTKLAQVRAIDMDWGANGQVTYSLHSDSHLEKVIEAFNIDSNTGWISTLKDLDHETDPAFSFFVVASDLGEAFSLSSMALVSVKVTDINDNAPVFAHEVYRGNVKESDPPGEVVAVLSTLDKDTSNINRQVSYHITGGNPRGQFALGMVQSEWKVYVKRPLDREEQDIYFLNITASDGLFVTQAMVEVTVSDVNDNSPVCDQVAYSASLPEDIPSNKIILKVSAKDADIGSNGDIRYSLYGSGNNEFFLDPESGELKTLAVLDRERVPVYNLIARATDGGGRFCSSSVLLLLEDVNDNPPVFSSNHYTACVYENTATKALLTRVQAMDPDVGINRKVVYSLEDSASGVFSIDSSSGVIVLEQPLDREQQSSYNISVRATDQSPGQSLSSLASVTITVLDINDNPPVFERRDYLVTVPEDTSLGTQVLSVFATSKDIGTNAEITYLIRSGNEQGKFSINPKTGGISVLEALDYETCRRFYLVVEAKDGGTPALSTAATVSIDLTDVNDNPPRFSQDVYSAVISEDALEGDSVILLIAEDVDSKPNGQIRFSIVGGDRDNEFAVDPILGLVKVKKKLDRERVSGYSLLIQAVDSGIPAMSSTTTVNIDISDVNDNSPVFTPANYTAVIQENKPVGTSILQLVVTDRDSFHNGPPFSFSILSGNEDEEFMLDSHGILRSAVVFRHMESPEYLLCIQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFEDVSPEDFVGLHMHGFRRILRNAVLTQKQDSLRIISIQPVVGTNQLDMLFAVEMHSSEFYKPAYLIQKLSNARRHLENVMHIAAILEKNCSGLDCQEQHCEQGLSLDSHALMTYSTARISFVCPRFYRNVRCTCNGGVCPGSNDPCVEKPCPEDMQCVGYEASRRPFLCQCPPGKLGECSGHTSLSFAGNSYIKYRLSENSKEEDFKLALRLRTLQSNGIIMYTRANPCMILKIVEGKLWFQLDCGSGPGILGISSRAVNDGSWHSVFLELNRNFTSLALDDSYVERRRAPLYFQTLSTDSAIFFGALVQADNVRSLTDTRVTQVLGGFQGCLDSVVLNHYELPLQNKRSSFAEVVGLTELKLGCVLYPDACQRSPCLHGGSCSSLPSGGYQCSCLSQFTGTNCESEITACFPNPCRNGGSCDPIGNTFVCSCKAGLTGVTCEDDVDECEREECENGGSCVNLFGSFFCNCTPGYVGQYCGLRPVVVPNIQAGHSYVGKEELIGIAVVLFVIFTLIVLFIVFRKKVFRKNYSRNNITLVQDPATAALLHKSNGIPFRSLRAGDGRNVYQEVGPPQVPVRPMAYTPCFQSDSRSNLDKGLDVLGGEPQEMSTFHPESPRILTARRGVVVCSVAPNLPAVSPCRSDCDSIRKNGWDTGSENKGTEDTGEVTCFTNSNKGSNSEVQSLSSFQSDSGDDNAYHWDTSDWMPGARLSDIEEMPNYESQDGGAAHQGSTRELESDYYLGGYDIDSEYPPPHEEEFLSRDQLPPPLPEDFPDQYEALPPSQPTSLTSTMSPDCRRRPRFHPSQYLPPHPLPGETDLGGPSSSCDFSTFAVNMNQGTEVMAPTDSVSLSLHNSRGTSSSEMSARCGFDDSEVAMSDYESAGELSLTNLHIPFVETQQQTQV

SEQ ID NO: 400 - protein, 4587 aa, Mus musculus
MGRHLTLLLLLLLFLQQFGDSDGSQRLEPTPPIQFTHFQYNVTVHENSAAKTYVGHPRKMGIYILDPSWEIRYKIVSGDSENLFKAEEYVLGDFCFLRIRTKGGNTAILNREVRDHYTLIVKAVEKATDAEARAKVRVQVLDTNDLRPLFSPTSYSVSLPENTAIRTSIARVSATDADIGTNGEFYYSFKDRTDVFAIHPTSGVVVLTGRLDFLETQLYELEILAADRGMKLYGSSGVSSLAKLTVHVEQANECAPIITAVTLSPSELDKDPTYAIITVEDCDQGANGEIASLSIVAGDFLQQFKTVRSFPGSKAFKVKAVGAVDWDSHPYGYNLTLQAKDKGTPPQFSPVKVVHIISPQFRAGPVKFEMDVYRAEISEFAPPHTPVVLVKAIPSYSHLRYVFKSAPGKPKFGLNHNTGLISILEPIRRQHTSHFELEVTTSDKRASARVVVKVLGTNSNPPEFTQTSYKASIDENAPIGAAVTRVSAMDPDEGENGYVTYSIANLNHVPFVIDHFTGTVSTSENLDYELMPRVYTLRIRASDWGLPYRREVEVLATITLNNLNDNTPLFERINCEGTIPRDLGVGEQITTVSAIDADELQLFRYQIEAGNELDLFGLNPSSGVLSLKHSLTDGLGAKVSFHSLRITATDGENFATPLYINLTVAASRKPVNLQCEETGVAKMLAEKLLQANKLHSQGDVEDIFFDSYSVNTHTPQFGVTLPTGIEVKENLPVGANILFMNATDLDSGFNGKLVYAISGGNDDSCFTIDMETGVLKVLSPLDREVMDKYTLNITVYDLGIPQKAAWRLLDVTVLDANDNAPEFLQESYFVEVSEDKEVNSEIIQVEATDKDLGPSGHVTYAILTDTEKFSIDSMTGVVKIIQPLDREVQPVHYLKIEARDQATEEPRLFSTVLLKVSLDDVNDNPPRFIPPNYSVKVREDLPEGTIIMWLEAYDPDVGQSSQVRYSLLDHGEGHFDVDKLSGAVRIVQQLDFEKKQLYNLTVRAKDKGKPVSLSSTCYVEVEVVDVNENLHTPVFSSFVEKGVVKEDVPTGSSVMTVSAHDEDTGRDGEIRYSIRDGSGIGVFRIDEETGVIETSDRLDRESTSHYWLTVYATDQGVVPLSSFIEVYIEVEDVNDNAPQTSEPVYYPEIMENSPKDVSVVQIEAFDPDSSSNDKLTYRITSGNPQGFFSIHPKTGLITTTSRKLDREQQDEHILEVTVTDNGVPPRSTIARVIVKILDENDNRPQFLQKFYKIRLPEREKADGDRSASKREPLYRVIAADKDEGPNAELSYSIEEGNEHGRFSIEPKTGVVSSKKFSAAGEYDILSIKAVDNGRPQKSSTTRLHIEWISKPKPSSEPISFEESVFSFTVMESDPVAHMIGVISVEPPGMPLWFDIIGGNYDSHFDVDKGTGTIIVAKPLDAEQKSSYNLTVEATDGTTTILTQVLIKVIDTNDHRPQFSTSKYEVAVPEDTEPEVEILQISAVDRDEKNKLIYTLQSSIDPASLKKFRLDPATGALYTAEKLDHEAIHQHVLTVMVRDQDVPVKRNFARIVVNVSDKNDHAPWFTSPSYDGRVYESAAVGSVVLQVTALDKDKGRNAEVLYSIESGNIGNSFTIDPILGSIKTARELDRSHQVDYDLMVKATDKGDPPMSEMTSVRIAVTVADNASPKFTSKEYSAEISEAIRIGSFVGMVSAHSQSSVMYEIRDGNMGDAFNINPHSGSIITQRALDFETLPMYSLTVQGTNMAGLSTNTTVVVHVRDENDNPPVFTQAEYSGFISESASVNSVVLTDRNVPLVIRATDADRESNALLVYQIVEPSVHNYFAIDPTTGAIRTVLSLDYEETHAFHFTVQVHDMGTPRLFAEYAANVTVHVIDINDCPPVFSKSLYEVSLLLPTYRGVNVITVNATDADSKAFSQVMYSITEGNIGEKFSMDHKTGTIAIQNTTQLRSRYELTVRASDGRFTSMASVKINVKESRESPLKFTQDAYSAVVKENSTEARTLAVITAIGNPLNEPLFYRILNPDRRFKISHTSGVLSTTGIPFDREQQETFDVVVEVTKEHEPSAVAHVVVKVTVEDQNDNAPVFVNLPYYAVVKVDAEVGHVIRYVTAIDRDSGRNGDIHYYLKEHHDHFQIGPSGDISLKKQFEHDTLNKEYLVTVVAKDGGSPAFSAEVLVPITVMNKAMPVFEKAFYSAEIPENIQMHSPVVHIQANSPEGLKVFYSITDGDPFSQFTINFNTGVVNVIAPLDFESHPAYKLSVRATDSLTGAHAEVFVDIIVEDINDNPPVFVQPSYSTTLSEASVIGTPVLQVRATDSDSEPNRGISYQLIGNHSKSHDHFHIDSNTGLISLVRALDYEQSQQHRIFVRAVDGGMPALSSDVVVTVAVTDLNDNPPLFEQQVYEARISEHAAHGHFVMCVRACDADSSDLDKLEYSILSGNDHKSFIIDRETGIITLSNLRRHTLKPFYSLNVSVSDGVFRSSARVNVTVMGGNLHSPVFHQNEYEVELAENAPLHTLVVQVKASDRDSGIYSHVTYHIVNDFAKDRFYVNDRGQIFTLEKLDRETPAEKVISIRLMAKDAGGKVAFCTVNVILTDDNDNAPQFRSTKYEVNIGSSAAKGTSVVKVFASDADEGSNADVTYAIEADSESVKENLEINKLTGLITTKESLIGLENEFFTFFVRAVDSGSPPRESVVPVYIKILPPEVQLPRFSEPFYTYTISEDTPIGTEIDLIRVEHGGAVLYILVKGNTPESNRDEFFVIDRQNGRLKLEKSLDHETTKWYQFSILARCTLDDYEVVASIDVSIQVKDANDNSPVLESSPYEAFIVENLPGGSRVIQIRASDLDSGANGQVMYSLDQSQDADIIESFAINMETGWITTLKELDHEERASYQIKVVASDHGEKVQLSSTAIVGVTVTDVNDSPPRFTAEIYKGTVSEDDPPGGVIAILSTTDADTEEINRQVSYFITGGDALGQFAVENVQSDWRVYVKKPLDREQKDSYLLTVTATDGTFSSKARVEVKVLDANDNSPVCEKTSYSDTIPEDALPGKLVMQVSATDADIRSNAEITYTLFGSGAEKFKLNPDTGELRTLALLDREEQAVYNLLVKATDGGGRSCQAAIVLTLEDVNDNAPEFTAEPYTITVFENTEPGTPLTRVQATDADTGLNRKISYSLVESADGQFSINERSGIIQLEKHLDRELQAVYTLTLKAVDQGLPRRLTATGTVVVSVLDINDNPPVFEYREYGASVSEDIVIGTEVLQVYAASRDIEANAEITYAIISGNEHGKFSIDSKTGAIFIIESLDYESSHEYYLTVEATDGGTPSLSDVATVNINVTDINDNSPVFSQDTYTTVVSEDAALEQPVITIMADDADGPSNSHIHYSIIEGNQGSPFTIDPVRGEVKVTKPLDRETISGYTLTVQAADNGNPPRVNTTTVNIDVSDVNDNAPLFSRDNYSVIIQENKPVGFSVLKLVVTDKDSSHNGPPFFFTIVSGNDENAFEVNQHGVLLTAATIKRKVKDHYFLHVKVADSGKPQLSSMTHIDIRVIEESIHPPAILPLEIFITAFGEEYSGGVIGKIHATDQDVYDTLMYSLDPHMDGLFSVSSTGGKLIAHRKLDIGQYLLNVSVTDGKFTTVADITVHIQQVTQEMLNHTVAIRFANLTPEEFVGDYWRNFQRALRNILGVRKNDIQIVSLQPSEPHSHLDVLLFVERSGGTTFSTKQLLHKINSSVTDVEEIIGVRILEVFQKLCAGLDCPWKFCDEKVSVDENVMSTHSTARLSFVTPRHHRTAVCLCKDGTCPPVHHGCEDNPCPAGSECVADPREEKYSCVCPGGGFGKCPGSSSITFTGNSFVKYRLLENENRLEMKLSMRLRTYSLHAVVMYARGTDYSIPGIVSVQSIQVNDGQWHAVSLEVEGNYAKLVLDEVHTASGTAPGALKTLNLDNYVFFGGHLRQQGTKHGRGAQVASGFRGCMDSIYLNGQELPLNNKPRAYAHIEEWVDLSHGCLLTATEDCSSSPCQNGGVCNPSPTGGYYCKCNALYVGTFCEVSVNPCSSNPCLSGGTFICIDSGVCSCSLGLVLLCSDCQLCSFCQDDPCQIGGTCFDSLDGAVCHCDSGFRGERFQIDIDECAGNPCRNGALCEITLSFYHCNCSQEYRGKHCEDASPNHYVSTPWNIGLAEGIGIIVFIAGIVLLVMVFVLCRKMISRKKKRQAEPEDKRLGPTTAFLQRPYFDSKLNKNIYFDIPAQVPVRPISYTFPSIPSDSRNNLDRNSFEGSAIPEHPEFSTFNPESMHGHRKAVAVCSVAPNLPPPPPSNSPSDSDSIQKPSWDFDYDAKVVDLDPCLSKKPLEEKPSQPYSARESLSEVQSLSSFQSESCDDNESLAAPDLSKPRGYHWDTSDWMPSVPLPDIQEFPNYEAIDEHTPLYSADPNAIDTDYYPGGYDIESDFPPPPEEFPAPDELPPLLPEFSDQFESIHPPRDMPAAGSLGFSSRSRQRFNLNQYLPNFYPADMSEPQKQGAGENSPCREPYTPYPPGYQRNFEAPTIENMPMSVYASTASCSDVSACCEVESEVMMSDYESGDDGHFEEVTIPPLDSQQHTEV

SEQ ID NO: 401 - protein, 4589 aa, Rattus norvegicus
MGRHLALLLLLLFFLQHFGDGDGSQRLEPTPSLQFTHVQYNVTVHENSAAKTYVGHPRKMGIYILDPSWEIRYKIISGDNENLFKAEEYVLGDFCFLRIRTKGGNTAILNREVRDHYTLVIKAVEKVTDAEARAKVRVQVLDTNDLRPLFSPTSYSVSLPENTAIRTSIARVSATDADIGTNGEFYYSFKDRTDMFAIHPTSGVVVLTGRLDVLETQRYELEILAVDRGMKLYGSSGVSSLAKLTVHVEQANECAPGITAVTLSPSELDKDPTYAIITVEDCDQGANGEIASLSIVAGDLLQQFKTVRSFPGSKAFKVKAVGGVDWDSHPYGYNLTVQAKDKGTPPQFSPVKVIHVISPQFRAGPVKFEMDVYRAEISEFAPPHTPVVLVKAIPSYSHLRYVFKSTPGKPKFGLNHNTGLISILEPIKRQHTSHFELEVTTSDRRASTKVVVKVVGTNSNPPEFTQTSYKASFDENAPVGTPVMRVSAVDPDEGENGYVTYSIANLNHVPFVIDHFTGAVSTSENLDYELMPRVYTLRIRASDWGLPYRREVEVLATITLNNLNDNTPLFEKTNCEGTIPRDLGVGEQITTVSAIDADELQLVRYQIEAGNELDLFGLNPSSGVLSLKHSLMDGLGAKVSFHSLRITATDGENFATPLYINLTVAASRKPVNLRCEETGVAKMLAEKLLQANKLHHQGDAEDIFFDSHSVNAHAPQFRGSLPTGIEVKEDLPVGASILFMNATDLDSGFNGKLVYAISGGNDDSCFTVDMETGMLKVLSPLDREVTDKYTLNITVYDLGIPQRAAWRLLDVTVLDANDNAPEFLQESYFVEVSEDKEINSEIIQVEATDKDLGPSGHVTYAILTDTEKFAIDRVTGVVKIIQPLDREVQRVHYLKIEARDQATEEPWLSSTVLLKVSLDDVNDNPPRFIPPSYSVKVREDLPEGTIIMWLEAHDPDVGQSSQVRYSLLDHGEGHFDVDKLSGAVRIVQQLDFEKKQLYNLTVRAKDKGKPASLSSTGYVEVEVVDVNENLHAPVFSSFVEKGTVKEDVPMGSSVMTVSAHDEDTGRDGEIRYSIRDGSGVGVFRIDEETGVIETSDRLDRESTSHYWLTVYATDQGVVPLSSFIEVYIEVEDVNDNAPQTSEPVYYPEIMENSPKDVSVVQIEAFDPDSSSSDKLTYRITSGNPQGFFSIHPKTGLITTTSRKLDREQQDEHILEVTVTDNGVPPRSTIARVIVKILDENDNRPQFLQKFYKIRLPEREKADGDRSAKREPLYRVIAADKDEGPNAELSYSIEEGNEHGRFSIEPKTGVVSSKKFSAAGEYDILSIKAIDNGRPQKSSTTRLHIEWISKPKPSLEPISFEESVFSFTVMESDPVAHMIGVISVEPPGMPLWFDIIGGNYDSHFDVDKGTGTIIVAKPLDAEQKSSYNLTVEATDGTSTILTQVLIKVIDTNDHRPQFSTSKYEVSVPEDTEPETEILQISAVDRDEKNKLIYTLQSSIDPASLKKFRLDPATGALYTSEKLDHEAIHQHVLTVMVRDQDVPVKRNFARIIVNVSDMNDHSPWFTSSSYEGRVYESAAVGSVVLQVTALDRDKGRNAEVLYSIESGNIGNSFTIDPILGSIKTARELDRSHQVDYDLMVKATDKGEPPMSEMTSVRISVTVADNASPKFTSKEYSAEISEAIRIGSFVGMVSAHSQSSVMYEVKDGNIGDAFNINPHSGSIVTQRALDFETLPIYTLTVQGTNMAGLSTNTTVVVHIQDENDNPPAFTRAEYSGFISESASVNSVVLTDKNVPLVIRATDADRESNALLVYQIVEPSVHNYFAIDPTTGAIHTVLSLDYEETRVFHFTVQVHDMGTPRLFAEYAANVTVHVIDINDCPPVFSKSLYEASLLLPTYKGVNVITVNATDADSRAFSQLIYSITKGNIGEKFSMDHKTGTIAIQNTTQLRSRYELTVRASDGRFTSVASVRINVKESRESPLKFTQDAYSAVVKENSTEAKTLAVITAIGNPINEPLFYRILNPDRRFKISHTSGVLSTTGIPFDREQQETFVVVVEVTKEREPSAVAHVVVKVTVEDQNDNAPVFVNLPYYAVVKVDAEVGHVIRHVTAIDRDSGRNGDVHYYLKEHHDHFEIGPSGDISLKKQFEHDTLNKEYLVTVVAKDGGNPAFSAEVLVPITVMNKAMPVFEKAFYSAEIPENVQTHSPVVHVQANSPEGLKVFYSITDGDPFSQFTINFNTGVINVIAPLDFESHPAYKLSIRATDSLTGAHAEVFVDIVVEDINDNPPVFVQQSYSTTLSEASVIGAPILQVRATDSDSEPNRGISYQLIGNHSKSHDHFHIDSHTGLISLVRALDYEQFQQHKLLVRAVDGGMPPLSSDVVVTVDVTDLNDNPPLFEQQVYEARISEHAAHGHFVMCVKACDADRSDLDRLEYSILSGNDHKSFVIDGETGIITLSNPRRHTLKPFYSLNVSVSDGVFRSSARVNVTVMGGNLHSPVFHQNEYEVELAENAPLHTLVVQVKATDRDSGIYGHLTYHLVNDFAKDRFYVNDGGQVFTLERLDREAPAEKVISVRLMAKDAGGKVAFCTVNVILTDDNDNAPQFRSTKYEVNVGSSAAKGTSVVKVFASDADEGSNADVTYAIEADSESVEENLEINQLTGLITTKESLIGLENEFFTFFVRAVDNGSPPKESVVPVYVKILPPEVQLPRFSEPFYTYSISEDMPIGTEIDLIRVEHSGTVLYTLVKGNTPESNRDEFFVIDRQSGRLKLEKSLDHETTKWYQFSILARCTLDDYEVVASIDVSIQVKDANDNSPVLESNPYEAFIVENLPAGSRVIQVRASDLDSGVNGQVMYSLDQSQDADIIESFAINMETGWITTLKELDHEERASYQIKVVASDHGEKVQLSSTAIVDVTVTDVNDSPPRFTAEIYKGTVSEDDPPGGVIAILSTTDADSEEINRQVSYFITGGDALGQFAVENMQNDWRVYVKKPLDREQKDSYLLTVTATDGTFSSKARVEVKVLDANDNSPVCERTAYSDAIPEDALPGKLVMQVSATDADIRSNAEITYTLFGSGAEKFKLNPDTGELRTLALLDREEQAVYHLLVKATDGGGRSCQATIVLTLEDVNDNTPEFTADPYAITVFENTEPGTPLTRVQATDADAGLNRKISYSLLDSADGQFSINEQSGILQLEKHLDRELQAVYTLTLKAADQGLPRKLTATGTVVVSVLDINDNPPVFEYREYGATVSEDIVIGTEVLQVYAASRDIEANAEITYAIISGNEHGKFSIDSKTGAIFIIENLDYESSHGYYLTVEATDGGTPSLSDVATVNINITDINDNSPVFSQDSYTTVVSEDAALEQPVITIMADDADGPSNSHILYSIIEGNQGSPFTIDPVRGEIKVTKPLDRETISGYTLTVQAADNGNPPRVNTTTVNIDVSDVNDNAPLFSRDNYSVIIQENKPVGFSVLKLVVTDKDSSHNGPPFSFAIVSGNDDNMFEVNQHGVLLTAATVKRKVKDHYLLHVKVADNGKPQLSSLTHIDIRVIEESIHPPAILPLEIFITASGEEYSGGVIGKIHATDQDVYDTLTYSLDPHMDGLFSVSSTGGKLIAHRKLDIGQYLLNVSVTDGKFTTVADITVHIQQVTQEMLNHTIAIRFANLTPEEFVGDYWRNFQRALRNILGIRKNDIQIVSLQPSEPHSHLDVLLFVEKSGGTQISTKQLLHKINSSVTDIEEIIGVRILDVFQKLCAGLDCPWKFCDEKVSVDENIMSTHSTARLSFVTPRHHRTAVCLCKDGTCPPVHQGCEDNPCPAGSECVADPREEKYSCVCPGGGFAKCPGSSSITFTGSSFVKYRLMENENRLEMKLTMRLRTYSSHAVVMYARGTDYSILEIHTGRLQYKFDCGSGPGIVSVQSIQVNDGQWHAVSLEVEGNYAKLVLDEVHTASGTAPGALKTLNLDNYVIFGGHLRQQGTKHGRNTQVANGFRGCMDSIYLNGQELPLNNKPRAYAHIEEWVDLAHGCLLTATEDCSSNPCQNGGVCNPSPTGGYYCKCSALHAGTYCEVSVNPCSSNPCLYGGTCMVDNGGFVCQCRGLYTGQRCQLSPYCKDEPCKNGGTCFDSLDGAVCQCDSGFRGERCQSDIDECAGNPCRNGALCENTHGSYHCNCSQEYRGKHCEDATPNHYVSTPWNIGLAEGIGIIVFIAGIFLLVVVFVLCRKMISRKKKHQAEPEDKRLGPTTAFLQRPYFDSKPSKNIYSDIPPQVPVRPISYTPSIPSDSRNNLDRNSFEGSAIPEHPEFSTFNPESMHGHRKAVAVCSVAPNLPPPPPSNSPSDSDSIQKPSWDFDYDAKVVDLDPCLSKKPLEEKPSQPYSARESLSEVQSLSSFQSESCDDNGYHWDTSDWMPSVPLPDIQEFPNYEVIDEHTPLYSADPNAIDTDYYPGGYDIESDFPPPPEDFPAPDELPPLPPEFSDQFESIHPPRDMPAAGSLGSSSRNRQRFNLNQYLPNFYPVDMSEPQKQGAGENSTCREPYTPYPPGYQRNFEAPTIENMPMSVYTSTASCSDVSACCEVESEVMMSDYESGDDGHFEEVTIPPLDSQQHTEV

SEQ ID NO: 402 - protein, 4551 aa, Mus musculus
MGHCMGTKPPSCIILLLLKLFATVSQGLPGTGPLGFHFTHSTYNATVYENSAARTYVNSQSRMGITLIDLSWDIKYRIVSGDEEGFFKAEEVIIADFCFLRIRTKGGNSAILNREIQDNYLLIIKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPIIHVVSHTPFSLDKEPTYAVVTVDDLDEGANGEIESLSIVDGDPLEQFFLAKEGKWLNEYKVKERRQVDWESFSYGYNLTIQAKDKGSPQKFSELKTVHIANPRRDNTPVRFEKDVYEVSISEFSPPGVLVAIVKVSPEPLDVEYKLLPGKDSDYFKINPRSGLIVTAQPLNTVKKEVYKLEVSDKEGDAKAQVTIGIEDANDHTPEFQEALYETFVNESVRVGTNVLTVSASDKDKGENGYITYSIASLNLLPFAINQFTGVISTTEELDFESSPETYRFIVRASDWGSPYRHESEVNVTIRVGNVNDNSPLFEKVACQGVISYDFPVGGHITAISAIDIDELELVKYKIISGNELGFFYLNPDSGVLQLKKSLMNSGIKNGNFALRITATDGENFADPMAINISVLHGKVSSKSFSCRETRVAQKLAEKLLIKAKANGKLNLEDGFLDFYSINRQGPHFDKSFPSDVAVKEDMLVGTNILKIKAYDADSGFNGKVLFTISDGNTDSCFNIDMETGQLKVLMPMDREHTDLYVLNITIYDLGKPQKSSWRLLTVNVEDANDNNPVFLQDSYSVSILESSSIGTEIIQVEARDKDLGSNGEVMYSVLTDTHQFIINSSTGIVYIADQLDRESKANYSLKIEARDKAESGQQLFSVVTLKIFLDDVNDCSPAFIPSSYSVKVLEDLPVGTVIAWLETQDPDLGLGGQVRYSLVNDYNGRFEVDKASGAIRLSKELDYEKQQFYNLTVRAKDKGRPVSLSSVSFVEVEVVDVNENLHTPYFPDFAVVGSVKENSRIGTSVLQVTAHDEDSGRDGEIQYSIRDGSGLGRFNIDDESGVITAADSLDRETTASYWLTVYATDRGVVPLYSTIEVYIEVEDVNDNAPLTSEPIYYPVVMENSPKDVSVIQIQAEDPDSGSNEKLTYRITSGNPQNFFAINIKTGLITTTSRKLDREQQAEHFLEVTVTDGGSSPKQSTIWVVVQVLDENDNRPQFPEKVYQIKLPERDRKKRGEPIYRAFAFDKDEGPNAEISYSIVDGNDDGKFFIDPKTGMVSSRKQFTAGSYDILTIKAVDNGRPQKSSTARLHIEWIKKPPPSPIPLTFDEPFYNFTVMESDKVTEIVGVVSVQPANTPLWFDIVGGNFDSSFDAEKGVGTIVIAKPLDAEQRSVYNMSVEVTDGTNIAVTQVFIKVLDNNDNGPEFSQPHYDVTISEDVLPDTEILQIEATDRDEKHKLSYTIHSSIDAVSMRKFRMDPSTGVLYTAERLDHEAQDKHILNIMVRDQEFPYRRNLARVIVNVEDANDHSPYFTNPLYEASVFESAALGSVVLQVTALDKDKGENAELIYSIEAGNTGNTFKIEPVLGIITISKEPDMAAMGQFVLSVKVTDQGSPPMSATAIVRISISMSDNSHPKFTHKDYQAEVNENVDIGTSVILISAISQSTLIYEVKDGNINGVFTINPYSGVITTRRALDYEHTSSYQLIIQATNMAGMASNATISVQIVDENDNPPVFLFSQYSGSLSEAAPINSIVRSLDNSPLVIRATDADSNQNALLVYQIVESTAKKFFTVDSSTGAIRTIANLDHEAIAHFHFHVHVRDSGNPQLTAESPVEVNIEVTDVNDNPPVFTQAVFETVLLLPTYIGVEVLKVSATDPDSEVPPELTYSLMEGSVDNFLMDPNTGVLTIKNNNLSKDHYMLIVRVSDGKFYSTAMVTVMVKEAMDSGLHFTQSFYSTSISENSTNITKVAIVNAVGNRLNEPLKYSILNPGNKFKIKSTSGVIQTTGVPFDREEQELYELVVEASRELDHLRVARVVVRVNIEDVNDNSPVFVGLPYYAAVQVDAEPGTLIYRVTAIDKDKGANGEVTYVLQDDYGHFEINPNSGNVILREAFNSDLSNIDYGVTILAKDGGNPSLSTFVELPITIVNKAMPVFDKPFYTASINEDITMNTPILSINATSPEGQGIIYLIIDGDPFQQFNIDFDTGVLKVISPLDYEVTSVYKLTVRASDALTGARAEVTVDLLVDDINDNPPVFDQPTYNTTLSESSLIGTPVLQLVSTDADSGNNKLVRYQIVQDTYNSTDYFHIDSSSGLILTARMLDHELVQHCTLKVTATDNGFPSLSSEVLVQIYISDVNDNPPVFNQLIYESYVSELAPRGHFVTCVQASDADSSDLDRLEYSILSGNDRASFLMDSKSGVLTLSSHRKQRMEPLYSLNVSVSDGLFTSTAQVHIRVLGANLYSPAFSQSTYVAEVRENAASGTKVIHVRATDGDPGTYGQVSYSIINDFAKDRFLIDSNGQIITTERLDRENPLEGDISIYLRALDGGGRTTFCTVRVIVVDENDNAPQFMTVEYRASVRADVGRGHLVTQVQALDPDDGANSRITYSLYSEASVSVADLLEIDPDNGWMVTKGNFNQLRNTVLSFFVKAVDGGIPVRHSLIPVYIHVLPPETFLPSFTQSQYSFTITEDTSIGSTVDTLRILPNQSVRFSMVNGERPENNKEGVFIIEQETGAIKLDKRLDHEVSPAFHFKVAATIPLDKVDIVFTVDVDVKVLDLNDNKPVFETSTYETIIMEGMPVGTKLAQVRAIDMDWGANGQVTYSLHSDSHLEKVIEAFNIDSNTGWISTLKDLDHETDPAFSFFVVASDLGEAFSLSSMALVSVKVTDINDNAPVFAHEVYRGNVKESDPPGEVVAVLSTLDKDTSNINRQVSYHITGGNPRGQFALGMVQSEWKVYVKRPLDREEQDIYFLNITASDGLFVTQAMVEVTVSDVNDNSPVCDQVAYSASLPEDIPSNKIILKVSAKDADIGSNGDIRYSLYGSGNNEFFLDPESGELKTLAVLDRERVPVYNLIARATDGGGRFCSSSVLLLLEDVNDNPPVFSSNHYTACVYENTATKALLTRVQAMDPDVGINRKVVYSLEDSASGVFSIDSSSGVIVLEQPLDREQQSSYNISVRATDQSPGQSLSSLASVTITVLDINDNPPVFERRDYLVTVPEDTSLGTQVLSVFATSKDIGTNAEITYLIRSGNEQGKFSINPKTGGISVLEALDYETCRRFYLVVEAKDGGTPALSTAATVSIDLTDVNDNPPRFSQDVYSAVISEDALEGDSVILLIAEDVDSKPNGQIRFSIVGGDRDNEFAVDPILGLVKVKKKLDRERVSGYSLLIQAVDSGIPAMSSTTTVNIDISDVNDNSPVFTPANYTAVIQENKPVGTSILQLVVTDRDSFHNGPPFSFSILSGNEDEEFMLDSHGILRSAVVFRHMESPEYLLCIQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFEDVSPEDFVGLHMHGFRRILRNAVLTQKQDSLRIISIQPVVGTNQLDMLFAVEMHSSEFYKPAYLIQKLSNARRHLENVMHIAAILEKNCSGLDCQEQHCEQGLSLDSHALMTYSTARISFVCPRFYRNVRCTCNGGVCPGSNDPCVEKPCPEDMQCVGYEASRRPFLCQCPPGKLGECSGHTSLSFAGNSYIKYRLSENSKEEDFKLALRLRTLQSNGIIMYTRANPCMILKIVEGKLWFQLDCGSGPGILGISSRAVNDGSWHSVFLELNRNFTSLALDDSYVERRRAPLYFQTLSTDSAIFFGALVQADNVRSLTDTRVTQVLGGFQGCLDSVVLNHYELPLQNKRSSFAEVVGLTELKLGCVLYPDACQRSPCLHGGSCSSLPSGGYQCSCLSQFTGTNCESEITACFPNPCRNGGSCDPIGNTFVCSCKAGLTGVTCEDDVDECEREECENGGSCVNLFGSFFCNCTPGYVGQYCGLRPVVVPNIQAGHSYVGKEELIGIAVVLFVIFTLIVLFIVFRKKVFRKNYSRNNITLVQDPATAALLHKSNGIPFRSLRAGDGRNVYQEVGPPQVPVRPMAYTPCFQSDSRSNLDKGLDVLGGEPQEMSTFHPESPRILTARRGVVVCSVAPNLPAVSPCRSDCDSIRKNGWDTGSENKGTEDTGEVTCFTNSNKGSNSEVQSLSSFQSDSGDDNAYHWDTSDWMPGARLSDIEEMPNYESQDGGAAHQGSTRELESDYYLGGYDIDSEYPPPHEEEFLSRDQLPPPLPEDFPDQYEALPPSQPTSLTSTMSPDCRRRPRFHPSQYLPPHPLPGETDLGGPSSSCDFSTFAVNMNQGTEVMAPTDSVSLSLHNSRGTSSSEMSARCGFDDSEVAMSDYESAGELSLTNLHIPFVETQQQTQV

SEQ ID NO: 403 - protein, 4590 aa, Homo sapiens
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVPAHLTVMVRDQDVPVKRNFARIVVNVSDTNDHAPWFTASSYKGRVYESAAVGSVVLQVTALDKDKGKNAEVLYSIESGTFGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 404 - protein, 2647 aa, Homo sapiens; identical to SEQ ID NO: 260

SEQ ID NO: 405 - protein, 2602 aa, Homo sapiens
MPVTEKDLAEDAPWKKIQQNTFTRWCNEHLKCVNKRIGNLQTDLSDGLRLIALLEVLSQKRMYRKYHQRPTFRQMQLENVSVALEFLDRESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVSVDKAQGDASKVTAKGPGLEAVGNIANKPTYFDIYTAGAGVGDIGVEVEDPQGKNTVELLVEDKGNQVYRCVYKPMQPGPHVVKIFFAGDTIPKSPFVVQVGEACNPNACRASGRGLQPKGVRIRETTDFKVDTKAAGSGELGVTMKGPKGLEELVKQKDFLDGVYAFEYYPSTPGRYSIAITWGGHHIPKSPFEVQVGPEAGMQKVRAWGPGLHGGIVGRSADFVVESIGSEVGSLGFAIEGPSQAKIEYNDQNDGSCDVKYWPKEPGEYAVHIMCDDEDIKDSPYMAFIHPATGGYNPDLVRAYGPGLEKSGCIVNNLAEFTVDPKDAGKAPLKIFAQDGEGQRIDIQMKNRMDGTYACSYTPVKAIKHTIAVVWGGVNIPHSPYRVNIGQGSHPQKVKVFGPGVERSGLKANEPTHFTVDCTEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTVDTRGAGGQGKLDVTILSPSRKVVPCLVTPVTGRENSTAKFIPREEGLYAVDVTYDGHPVPGSPYTVEASLPPDPSKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEAGLLSVDCSEAGPGALGLEAVSDSGTKAEVSIQNNKDGTYAVTYVPLTAGMYTLTMKYGGELVPHFPARVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDDIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGTGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 406 - protein, 2647 aa, Mus musculus
MSSSHSRCGQSAAVASPGGSIDSRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVNNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGMGEVEVVIQDPTGQKGTVEPQLEARGDSTYRCSYQPTMEGVHTVHVTFAGVPIPRSPYTVTVGQACNPAACRAIGRGLQPKGVRVKETADFKVYTKGAGSGELKVTVKGPKGEERVKQKDLGDGVYGFEYYPTIPGTYTVTITWGGQNIGRSPFEVKVGTECGNQKVRAWGPGLEGGIVGKSADFVVEAIGDDVGTLGFSVEGPSQAKIECDDKGDGSCDVRYWPQEAGEYAVHVLCNSEDIRLSPFMADIREAPQDFHPDRVKARGPGLEKTGVAVNKPAEFTVDAKHAGKAPLRVQVQDNEGCSVEATVKDNGNGTYSCSYVPRKPVKHTAMVSWGGVSIPNSPFRVNVGAGSHPNKVKVYGPGVAKTGLKAHEPTYFTVDCTEAGQGDVSIGIKCAPGVVGPTEADIDFDIIRNDNDTFTVKYTPCGAGSYTIMVLFADQATPTSPIRVKVEPSHDASKVKAEGPGLNRTGVELGKPTHFTVNAKTAGKGKLDVQFSGLAKGDAVRDVDIIDHHDNTYTVKYIPVQQGPVGVNVTYGGDHIPKSPFSVGVSPSLDLSKIKVSGLGDKVDVGKDQEFTVKSKGAGGQGKVASKIVSPSGAAVPCKVEPGLGADNSVVRFVPREEGPYEVEVTYDGVPVPGSPFPLEAVAPTKPSKVKAFGPGLQGGNAGSPARFTIDTKGAGTGGLGLTVEGPCEAQLECLDNGDGTCSVSYVPTEPGDYNINILFADTHIPGSPFKAHVAPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTDTYVQDCGDGTYKVEYTPYEEGVHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGSYSISVLYGEEEVPRSPFKVKVLPTHDASKVKASGPGLNTTGVPASLPVEFTIDAKDAGEGLLAVQITDPEGKPKKTHIQDNHDGTYTVAYVPDVPGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPTVQTPLRSQQLAPQYNYPQGSQQTWIPERPMVGVNGLDVTSLRPFDLVIPFTIKKGEITGEVRMPSGKVAQPSITDNKDGTVTVRYSPSEAGLHEMDIRYDNMHIPGSPLQFYVDYVNCGHITAYGPGLTHGVVNKPATFTVNTKDAGEGGLSLAIEGPSKAEISCTDNQDGTCSVSYLPVLPGDYSILVKYNDQHIPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANIGSHCDLSLKIPEISIQDMTAQVTSPSGKTHEAEIVEGENHTYCIRFVPAEMGMHTVSVKYKGQHVPGSPFQFTVGPLGEGGAHKVRAGGPGLERAEVGVPAEFGIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGIYLIDVKFNGTHIPGSPFKIRVGEPGHGGDPGLVSAYGAGLEGGVTGSPAEFIVNTSNAGAGALSVTIDGPSKVKMDCQECPEGYRVTYTPMAPGSYLISIKYGGPYHIGGSPFKAKVTGPRLVSNHSLHETSSVFVDSLTKVATVPQHATSGPGPADVSKVVAKGLGLSKAYVGQKSNFTVDCSKAGNNMLLVGVHGPRTPCEEILVKHMGSRLYSVSYLLKDKGEYTLVVKWGDEHIPGSPYRIMVP

SEQ ID NO: 407 - protein, 2725 aa, Homo sapiens
MMNNSGYSDAGLGLGDETDEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVENAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDSTFRCTYRPAMEGPHTVHVAFAGAPITRSPFPVHVSEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGVQKVRAWGPGLETGQVGKSADFVVEAIGTEVGTLGFSIEGPSQAKIECDDKGDGSCDVRYWPTEPGEYAVHVICDDEDIRDSPFIAHILPAPPDCFPDKVKAFGPGLEPTGCIVDKPAEFTIDARAAGKGDLKLYAQDADGCPIDIKVIPNGDGTFRCSYVPTKPIKHTIIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGRYTIMVLFANQEIPASPFHIKVDPSHDASKVKAEGPGLNRTGVEVGKPTHFTVLTKGAGKAKLDVQFAGTAKGEVVRDFEIIDNHDYSYTVKYTAVQQGNMAVTVTYGGDPVPKSPFVVNVAPPLDLSKIKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIRPVFDPSKVRASGPGLERGKVGEAATFTVDCSEAGEAELTIEILSDAGVKAEVLIHNNADGTYHITYSPAFPGTYTITIKYGGHPVPKFPTRVHVQPAVDTSGVKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGRPIPGSPFRVPVKDVVDPGKVKCSGPGLGAGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGQETVITVDAKAAGEGKVTCTVSTPDGAELDVDVVENHDGTFDIYYTAPEPGKYVITIRFGGEHIPNSPFHVLACDPLPHEEEPSEVPQLRQPYAPPRPGARPTHWATEEPVVPVEPMESMLRPFNLVIPFAVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITESDLSQLTASIRAPSGNEEPCLLKRLPNRHIGISFTPKEVGEHVVSVRKSGKHVTNSPFKILVGPSEIGDASKVRVWGKGLSEGHTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKVEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTLNAGSGALSVTIDGPSKVQLDCRECPEGHVVTYTPMAPGNYLIAIKYGGPQHIVGSPFKAKVTGPRLSGGHSLHETSTVLVETVTKSSSSRGSSYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVKVP

SEQ ID NO: 408 - protein, 2210 aa, Drosophila melanogaster
MEAERDLAEDAQWKKIQQNTFTRWANEHLKTIDRSINNLETDLSDGLRLIALIEVLSQKRMPKYNKRPTFRSQKLENVSVALKFLQDEGIKIVNIDSSDIVDCKLKLILGLIWTLILHYSISMPMWDGEDDKQLNGSGHTPKQRLLNWIHAKIPDLPINNFTNDWTTGKAVGALVDACAPGLCPDWELWDPKDAVQNASEAMGLADDWLNVRQLIKPEELVNPNVDEQSMMTYLSQYPNSKLKTGAPLRPKTNPNRVRAYGPGIEPIGPVVGAPANFTVETFSAGKGSVDVDIQGPNGEIEKADVRFNNDKNLTYTVSYIPKSEGSHKVAVKFSGRDIPKSPFPVKVEGHAGDASKVKVTGPGIQPNGVTIKKPTFFDILAKDAGRGVPEVIIIDPANHKTSVAAKVRQLENDTWRCEYVTALQGLHSVNVFYAGTPIPNSPFPVKVAPLSDARKVRASGRGLQATGVRVGDDADFKIYTEGAGEGEPEVRVIGPGGMNQNVMQSKVDGNTYECHYYPTKEGRYVIMVTFAGQEVAKSPFEVKVGPKKESSIVAYGPGLSSGVIGYPAAFVVETNGETGALGFTVAGPSQAEIECHDNGDGSALVKYHPTAVGEYAVHILCDNEDIPKSPFIAQILPRTDFHPELVKASGPGLEKNGVTINQPTSFTVDPSKAGNAPLDVVVQDVFGTKLPVELKNNPDGTKKVTYTPTSGVPHTVEVNYGGVSTPNSPHRVYVGVPVDAAKVQAFGPWLQPGVRPNAATHFNVDAREAGDAELKVKIIHEETKIEVPCRIIDNEDNTYSVEVIPPSKGAYTTTMTYGGQRVPLGEKVVVEQTVDVSKIKVDGLEPSVIMNAATDFMVDMSKVGSNIDSGKLSCAIFDPMGHVLPSKIVQGPTDDIFRIMYTPFEAGRHTIELMYDNIPVPGSPFVVNVKSGCDPARCKAYGPGLEKGLTNQKNKFTVETKGAGNGGLSLAIEGPSEAKMTCTDNRDGSCDVDYLATDPGEYDITIRFADKHIPGSPFRVLVEETVDPSKVKVYGPGIEHGQVRESVPTFFNVDVGEAGPGRIAVKLTNSEGIPVDNLRVEDKGNCIYAVHYVPPKAGSVLTCQVKFSEVEVPCSPFVMTVFPKSEPTKVKVKGVNEKKKTPASLPAEFEIDTKQAGQADINVAIKNPKGKAMQPRLEEVSTGTYVVSFVPDECGTYQCSIKYGDKEIEGSPFKLEAFPTGEAKKCKLVEQAPKIQTSGSQSHLKVDAREAGDGAVTCKITNKAGSEIVDIDVIEKDGFFDILYALNDPGDYDINVKFGGKDIPNGSFSIKAVESIEQYSHSEYIEEHTTKVVQQTTQSELVNGKSEITYRSVAFEKLPLPTTGGNVTAEVRMPSGKVDKPVIQDNRDGTVSVKYDPREEGSHELVVKYNGEPVQGSPFKFHVDSITSGYVTAYGPGLTHGVTGEPANFTISTKGASAGGLTMAVEGPSKADINYHDNKDGTVSVQYLPTAPGEYQVSVRFGDKHIKGSPYFAKITGEGRKRNQISVGSCSEVTMPGDITDDDLRALNASIQAPSGLEEPCFLKRMPTGNIGISFTPREIGEHLVSVKRLGKHINNSPFKVTVCEREVGDAKKVKVSGTGLKEGQTHADNIFSVDTRNAGFGGLSVSIEGPSKAEIQCTDKDDGTLNISYKPTEPGYYIVNLKFADHHVEGSPFTVKVAGEGSNRKREKIQRERDAVPITEIGSQCKLTFKMPGITSFDLAACVTSPSNVTEDAEIQEVEDGLYAVHFVPKELGVHTVSVRYSEMHIPGSPFQFTVGPLRDSGSHLVKAGGSGLERGVVGEAAEFNVWTREAGGGSLAISVEGPSKADIEFKDRKDGSCDVSYKVTEPGEYRVGLKFNDRHIPDSPFKVYVSPDAGDAHKLEVQQFPQGNIQADAPYQFMVRKNGAKGELDAKIVAPSGTDDDCFIQVIDGEMYSVRFYPRENGIHAIHVKFNGVHIPDSPFRIKVGKDVADPAAVHASGNGLDEVKTGHKADFIINTCNAGVGTLAVSIDGPSKVAMDCTEVEEGYKVRYTPLLPGEHYITVKYNNMHIVGSPFKVNATGDKLADEGAQETSTVIVETVQKVAKGGKNTGVHLPTFKSDASKVVSKGMGLKKAYIGKQNQFSISATDAGNNILYVGMYGPKGPCEEFHVKHAGHNNYNVQYLVRDRGQYVLLIKWGEEHIPGSPFQIDV

SEQ ID NO: 409 - protein, 2639 aa, Rattus norvegicus
MSSSHSRSGQSAAGASPAGGIDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVNNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGIGEVEVVIQDPTGQKGTVEPQLEARGDSTYRCSYQPTMEGVHTVHVTFAGVPIPRSPYTVTVGQACNPTACRAVGRGLQPKGVRVKETADFKVYTKGAGSGELKVTVKGPKGEERVKQKDLGDGVYGFEYYPTIPGTYTVTITWGGQNIGRSPFEVKVGTECGNQKVRAWGPGLEGGIVGKSADFVVEAIGDDVGTLGFSVEGPSQAKIECDDKGDGSCDVRYWPQEAGEYAVHVLCNSEDIRLSPFMADIREAPQDFHPDRVKARGPGLEKTGVAINKPAEFTVDAKHAGKAPLRVQVQDNEGHSVETTVKDNGNGTYSCSYVPRKPVKHTAMVSWGGVSIPNSPFRVNVGAGSHPNKVKVYGPGVAKTGLKAHEPTYFTVDCTEAGQGDVSIGIKCAPGVVGPTEADIDFDIIRNDNDTFTVKYTPCGAGSYTIMVLFADQATPTSPIRVKVEPSHDASKVKAEGPGLNRTGVELGKPTHFTVNAKTAGKGKLDVQFSGLAKGDAVRDVDIIDHHDNTYTVKYTPVQQGPVGVSVTYGGDHIPKSPFSVGVSPSLDLSKIKVSGLVDKVDVGKDQEFTVKSKGAGGQGKVASKIVSPSGAAVPCKVEPGLGADNSVVRFVPREEGPYEVEVTYDGVPVPGSPFPVEAVAPTKPSKVKAFGPGLQGGNAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTDTYVQDCGDGTYKVEYTPYEEGVHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGSYSISVLYGEEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPTVQTPLRPQQLPSQYTYPQGSQQTWIPERPMVGVNGLDVTSLRPFDLVIPFTIKKGEITGEVRMPSGKVAQPSITDNKDGTVTVRYSPSEAGLHEMDIRYDNMHIPGSPLQFYVDYVNCGHITAYGPGLTHGVVNKPATFTVNTKDAGEGGLSLAIEGPSKAEISCTDNQDGTCSVSYLPVLPGDYSILVKYNDQHIPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKTHEAEIVEGENHTYCIRFVPAEMGMHTVSVKYKGQHVPGSPFQFTVGPLGEGGAHKVRAGGPGLERAEAGVPAEFGIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGSPAEFIVNTSNAGAGALSVTIDGPSKVKMDCQECPEGYRVTYTPMAPGSYLISIKYGGPYHIGGSPFKAKVTGPRLVSNHSLHETSSVFVDSLTKVATVPQHATSGPGPADVSKVVAKGLGLSKAYVGQKSNFTVDCSKAGNNMLLVGVHGPRTPCEEILVKHMGSRLYSVSYLLKDKGEYTLVVKWGDEHIPGSPYRIMVP

SEQ ID NO: 410 - protein, 2602 aa, Mus musculus
MPVTEKDLAEDAPWKKIQQNTFTRWCNEHLKCVNKRIGNLQTDLSDGLRLIALLEVLSQKRMHHKYHQRPTFRQMKLENVSVALEFLDHESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPRKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEARVTPDSDKNKTYSVEYLPKVTGLHKVIVLFAGQHISKSPFEVNVDKAQGDASKVTAKGPGLETTGNIANKPTYFDIYTAGAGVGDIGIEVEDPQGKNSVELLVEDRGNQVYRCVYKPVQPGPHVVKVSFAGDAIPKSPFGVQIGEACNPNACRASGRGLQPKGVRIRETADFKVDTKAAGSGELGVTVKGPKGLEELVKQKGFLDGVYSFEYYPSTPGKYSVAVTWGGHHIPKSPFEVQVGPEAGMQKVRAWGPGLHGGIVGRSADFVVESIGSEVGTLGFAIEGPSQAKIEYDDQNDGSCDVKYWPKEPGEYAVHIMCDDEDIKDSPYMAFIHPATGDYNPDLVQAYGPGLEKSGCTINNPAEFIVDPKDAGSAPLKILAQDGEGQPIDIQMKSRMDGTYACSYTPLKAIKHTIAVVWGGVNIPHSPYRVNIGQGSHPQKVKVFGPGVERSGLKANEPTHFTVDCTEAGEGDVSVGIKCDARVLSDDEEDVDFDIIHNANDTFTVKYVPPAPGRYTIKVLFASQEIPASPFRVKVDPSHDASKVKAEGPGLSKAGVENGKPTHFTVHTKGAGKAPLNVQFSSPLPGEAVKDLDIIDNYDYSHTVKYTPTQQGNMQVLVTYGGDPIPKSPFTVGVAAPLDLSKIKINGLENRVEVGKDQEFAIDTNGAGGQGKLDVTILSPSRKVVPCLVAPVAGRECSTAKFIPREEGLFAVDVTYDGHPVPGSPYTVEASLPPDPTKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEPGILCVDCSEAGPGTLGLEAVSDSGAKAEVSIQNNKDGTYAVTYVPLTAGMYTLTMKYGGELVPHFPAWVKVEPAIDTSGIKAFGPGIEGKDVFREATTDFTVDSRPLTQVGGDHIKAQITNPSGASTECFVKDNADGTYQVEYTPFEKGFHVVEVTYDDVPIPNSPFKVAVTEGCQPSRVHAQGPGLKEAFTNKSNVFTVVTRGAGIGGLGITVEGPSESKINCRDNKDGSCSAEYIPFAPGDYDVNITYGGVHIPGSPFRVPSKDVVDPSKVKIAGPGLSSCVRACIPQSFTVDSSKAGLAPLEVRVLGPRGLVEPVNVVDNGDGTHTVTYTPSQEGPYIVSVKYADEEIPRSPFKVKVLPTYDASKVTASGPGLSAYGVPASLPVEFAIDARDAGEGLLAVQITDQEGKPQRATVHDNKDGTYAVTYIPDKTGRYMIGVTYGGDNIPLSPYRIRATQTGDASKCLATGPGIAPTVKTGEEVGFVVDAKTAGKGKVTCVILTPDGTEAEADVIENEDGTYDIFYTAAKPGTYVIYVRFGGVDIPNSPFTVMATDGEVTAMEEAPVNACPPGFRPWVTEEAYVPVSDMNGLGFKPFDLVIPFAVRKGEITGTVHMPSGKKATPEIVDNKDGTVTVRYAPTEVGLHEMHIKYRGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDNRRCSQVKLGSAADFLLDISETDLSTLTASIKAPSGRDEPCLLKRLPNNHIGISFIPREVGEHLVSIKKNGNHVANSPVSIMVVQSEIGDARRAKVYGQGLSEGRTFEMSDFIVDTRDAGYGGISLAVEGPSKVDIQTEDLEDGTCKVSYFPTVPGVYIVSTKFADEHVPGSPFTVKISGEGRVRESITRTSRAPAVATVGSICDLNLKIPEINSSDMSAHVTSPSGHVTEAEIVPMGKNSHCVRFVPQEMGVHTVSVKYRGQHVTGSPFQFTVGPLGEGGAHKVRAGGPGLERGEAGIPAEFSIWTREAGAGGLSIAVEGPSKAEITFDDHKNGSCGVSYIAQEPGNYEVSIKFNDEHIPDSPYLVPVIAPSDDARCLTVLSLQESGLKVNQPASFAIRLNGAKGKIDAKVHSPSGAVEECHVSELEPDKYAVRFIPHENGIHTIDVKFNGSHVVGSPFKVRVGEPGQAGNPALVSAYGAGLETGTTGIQSEFFINTTQAGPGTLSVTIEGPSKVKMDCQEIPEGYKVMYTPMAPGNYLIGVKYGGPNHISRSPFKAKVTGQRLVSPGSANETSSILVESVTRSSTETCYSAIPKSSSDASKVTSKGAGLSKAFVGQKSSFLVDCSKAGSNMLLIGVHGPTTPCEEVSMKHVGKQQYNVTYVVKERGDYVLAVKWGEEHIPGSPFHVTVP

SEQ ID NO: 411 - protein, 2726 aa, Mus musculus
MMNNSNYSDASGLGLVDEADEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVQNAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDNTFRCTYRPVMEGPHTVHVAFAGAPITRSPFPVHVAEACNPNACRASGRGLQPKGVRVKEVADFKVFTKGAGSGELKVTVKGPKGTEEPVKVREAGDGVFECEYYPVVPGKYVVTITWGGYAIPRSPFEVQVSPEAGAQKVRAWGPGLETGQVGKSADFVVEAIGTEVGTLGFSIEGPSQAKIECDDKGDGSCDVRYWPTEPGEYAVHVICDDEDIRDSPFIAHIQPAPPDCFPDKVKAFGPGLEPTGCIVDRPAEFTIDARAAGKGDLKLYAQDADGCPIDIKVIPNGDGTFRCSYVPTKPIKHTIIVSWGGVNVPKSPFRVNVGEGSHPERVKVYGPGVEKTGLKANEPTYFTVDCSEAGQGDVSIGIKCAPGVVGPVEADIDFDIIKNDNDTFTVKYTPPGAGHYTIMVLFANQEIPASPFHIKVDPSHDASKVKAEGPGLSRTGVEVGKPTHFTVLTKGAGKAKLDVHFAGAAKGEAVRDFEIIDNHDYSYTVKYTAVQQGNMAVTVTYGGDPVPKSPFVVNVAPPLDLSKVKVQGLNSKVAVGQEQAFSVNTRGAGGQGQLDVRMTSPSRRPIPCKLEPGGGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIQPVFDPSKVRASGPGLERGKAGEAATFTVDCSEAGEAELTIEILSDAGVKAEVLIQNNADGTYHITYSPAFPGTYTITIKYGGHPIPKFPTRVHVQPAVDTSGIKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYIPFTPGDYDVNITFGGQPIPGSPFRVPVKDVVDPGKVKCSGPGLGTGVRARVPQTFTVDCSQAGRAPLQVAVLGPTGVAEPVEVRDNGDGTHTVHYTPATDGPYTVAVKYADQEVPRSPFKIKVLPSHDASKVRASGPGLNASGIPASLPVEFTIDARDAGQGLLTVQILDPEGKPKKANIRDNGDGTYTVSYLPDMSGRYTITIKYGGDEIPYSPFRIHALPTGDASKCLVTVSIGGHGLGACLGPRIQIGEETVITVDAKAAGKGKVTCTVSTPDGAELDVDVVENHDGTFDIYYTAPEPGKYVITIRFGGEHIPNSPFHVLACDPLPHVEEPAEMLQMRQPYAPLRPGTCPTHWATEEPVVPVEPLESMLRPFNLVIPFTVQKGELTGEVRMPSGKTARPNITDNKDGTITVRYAPTEKGLHQMGIKYDGNHIPGSPLQFYVDAINSRHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITEGDLSQLTASIRAPSGNEEPCLLKRLPNRHIGISFTPKEVGEHVVSVRKSGKHVTNSPFKILVGPSEIGDASKVRVWGKGLSEGQTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKTEAAEIVEGEDSAYSVRFVPQEMGPHTVTVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTQNAGSGALSVTIDGPSKVQLDCRECPEGHVVTYTPMAPGNYLIAIKYGGPQHIVGSPFKAKVTGPRLSGGHSLHETSTVLVETVTKSSSSRGASYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVNVP

SEQ ID NO: 412 - protein, 2639 aa, Mus musculus
MSSSHSRCGQSAAVASPGGSIDSRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVNNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGMGEVEVVIQDPTGQKGTVEPQLEARGDSTYRCSYQPTMEGVHTVHVTFAGVPIPRSPYTVTVGQACNPAACRAIGRGLQPKGVRVKETADFKVYTKGAGSGELKVTVKGPKGEERVKQKDLGDGVYGFEYYPTIPGTYTVTITWGGQNIGRSPFEVKVGTECGNQKVRAWGPGLEGGIVGKSADFVVEAIGDDVGTLGFSVEGPSQAKIECDDKGDGSCDVRYWPQEAGEYAVHVLCNSEDIRLSPFMADIREAPQDFHPDRVKARGPGLEKTGVAVNKPAEFTVDAKHAGKAPLRVQVQDNEGCSVEATVKDNGNGTYSCSYVPRKPVKHTAMVSWGGVSIPNSPFRVNVGAGSHPNKVKVYGPGVAKTGLKAHEPTYFTVDCTEAGQGDVSIGIKCAPGVVGPTEADIDFDIIRNDNDTFTVKYTPCGAGSYTIMVLFADQATPTSPIRVKVEPSHDASKVKAEGPGLNRTGVELGKPTHFTVNAKTAGKGKLDVQFSGLAKGDAVRDVDIIDHHDNTYTVKYIPVQQGPVGVNVTYGGDHIPKSPFSVGVSPSLDLSKIKVSGLGDKVDVGKDQEFTVKSKGAGGQGKVASKIVSPSGAAVPCKVEPGLGADNSVVRFVPREEGPYEVEVTYDGVPVPGSPFPLEAVAPTKPSKVKAFGPGLQGGNAGSPARFTIDTKGAGTGGLGLTVEGPCEAQLECLDNGDGTCSVSYVPTEPGDYNINILFADTHIPGSPFKAHVAPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTDTYVQDCGDGTYKVEYTPYEEGVHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGSYSISVLYGEEEVPRSPFKVKVLPTHDASKVKASGPGLNTTGVPASLPVEFTIDAKDAGEGLLAVQITDPEGKPKKTHIQDNHDGTYTVAYVPDVPGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPTVQTPLRSQQLAPQYNYPQGSQQTWIPERPMVGVNGLDVTSLRPFDLVIPFTIKKGEITGEVRMPSGKVAQPSITDNKDGTVTVRYSPSEAGLHEMDIRYDNMHIPGSPLQFYVDYVNCGHITAYGPGLTHGVVNKPATFTVNTKDAGEGGLSLAIEGPSKAEISCTDNQDGTCSVSYLPVLPGDYSILVKYNDQHIPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANIGSHCDLSLKIPEISIQDMTAQVTSPSGKTHEAEIVEGENHTYCIRFVPAEMGMHTVSVKYKGQHVPGSPFQFTVGPLGEGGAHKVRAGGPGLERAEVGVPAEFGIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGIYLIDVKFNGTHIPGSPFKIRVGEPGHGGDPGLVSAYGAGLEGGVTGSPAEFIVNTSNAGAGALSVTIDGPSKVKMDCQECPEGYRVTYTPMAPGSYLISIKYGGPYHIGGSPFKAKVTGPRLVSNHSLHETSSVFVDSLTKVATVPQHATSGPGPADVSKVVAKGLGLSKAYVGQKSNFTVDCSKAGNNMLLVGVHGPRTPCEEILVKHMGSRLYSVSYLLKDKGEYTLVVKWGDEHIPGSPYRIMVP

SEQ ID NO: 413 - protein, 2726 aa, Rattus norvegicus
MMNNSNYSDASGLGLLDEADEMPSTEKDLAEDAPWKKIQQNTFTRWCNEHLKCVGKRLTDLQRDLSDGLRLIALLEVLSQKRMYRKFHPRPNFRQMKLENVSVALEFLEREHIKLVSIDSKAIVDGNLKLILGLIWTLILHYSISMPMWEDEDDEDARKQTPKQRLLGWIQNKVPQLPITNFNRDWQDGKALGALVDNCAPGLCPDWEAWDPNQPVQNAREAMQQADDWLGVPQVIAPEEIVDPNVDEHSVMTYLSQFPKAKLKPGAPVRSKQLNPKKAIAYGPGIEPQGNTVLQPAHFTVQTVDAGVGEVLVYIEDPEGHTEEAKVVPNNDKDRTYAVSYVPKVAGLHKVTVLFAGQNIERSPFEVNVGMALGDANKVSARGPGLEPVGNVANKPTYFDIYTAGAGTGDVAVVIVDPQGRRDTVEVALEDKGDNTFRCTYRPVMEGPHTVHVAFAGAPITRSPFPVHVAEACNPNACRASGRGLQPKGVRVKEVADFKVFTKGAGSGELKVTVKGPKGTEEPVKVREAGDGVFECEYYPVIPGKYVVTITWGGYAIPRSPFEVQVSPEAGAQKVRAWGPGLETGQVGKSADFVVEAIGTEVGTLGFSIEGPSQAKIECDDRGDGSCDVRYWPTEPGEYAVHVICDDEDIRDSPFIAHIQPAPPDCFPDKVKAFGPGLEPTGCIVDRPAEFTIDARAAGKGDLKLYAQDADGCPIDIKVIPNGDGTFRCSYVPTKPIKHTVIISWGGVNVPKSPFRVNVGEGSHPERVKVYGPGVEKTGLKANEPTYFTVDCSEAGQGDVSIGIKCAPGVVGPAEADIDFDIIKNDNDTFTVKYTPPGAGHYTIMVLFANQEIPASPFHIKVDPSHDASKVKAEGPGLSRTGVEVGKPTHFTVLTKGAGKAKLDVHFAGAAKGEAVRDFEIIDNHDYSYTVKYTAVQQGNMAVTVTYGGDPVPKSPFVVNVAPPLDLSKVKVQGLNSKVAVGEEQAFLVNTRGAGGQGQLDVRMTSPSRRPIPCKLEPGSGAEAQAVRYMPPEEGPYKVDITYDGHPVPGSPFAVEGVLPPDPSKVCAYGPGLKGGLVGTPAPFSIDTKGAGTGGLGLTVEGPCEAKIECQDNGDGSCAVSYLPTEPGEYTINILFAEAHIPGSPFKATIQPVFDPSKVRASGPGLERGKAGEAATFTVDCSEAGEAELTIEILSDAGVKAEVLIHNNADGTYHITYSPAFPGTYTITIKYGGHPIPKFPTRVHVQPAVDTSGIKVSGPGVEPHGVLREVTTEFTVDARSLTATGGNHVTARVLNPSGAKTDTYVTDNGDGTYRVQYTAYEEGVHLVEVLYDEVAVPKSPFRVGVTEGCDPTRVRAFGPGLEGGLVNKANRFTVETRGAGTGGLGLAIEGPSEAKMSCKDNKDGSCTVEYVPFTPGDYDVNITFGGQPIPGSPFRVPVKDVVDPGKVKCSGPGLGTGVRARVPQTFTVDCSQAGRAPLQVAVLGPTGVAEPVEVRDNGDGTHTVHYTPATDGPYTVAVKYADQEVPRSPFKIKVLPAHDASKVRASGPGLNASGIPASLPVEFTIDARDAGEGLLTVQILDPEGKPKKANIRDNGDGTYTVSYLPDMSGRYTITIKYGGDEIPYSPFRIHALPTGDASKCLVTVSIGGHGLGACLGPRIQIGEETVITVDAKAAGKGKVTCTVSTPDGAELDVDVVENHDGTFDIYYTAPEPGKYVITIRFGGEHIPNSPFHVLACDPLPHVEEPAEVLQLHQPYAPLRPGTCPTHWATEEPVVPVEPLESMLRPFNLVIPFTVQKGELTGEVRMPSGKTARPNITDNKDGTITVRYAPTEKGLHQMGIKYDGNHIPGSPLQFYVDAINSGHVSAYGPGLSHGMVNKPATFTIVTKDAGEGGLSLAVEGPSKAEITCKDNKDGTCTVSYLPTAPGDYSIIVRFDDKHIPGSPFTAKITGDDSMRTSQLNVGTSTDVSLKITEGDLSQLTASIRAPSGNEEPCLLKRLPNRHIGISFTPKEVGEHVVSVRKSGKHVTNSPFKILVGPSEIGDASKVRVWGKGLSEGQTFQVAEFIVDTRNAGYGGLGLSIEGPSKVDINCEDMEDGTCKVTYCPTEPGTYIINIKFADKHVPGSPFTVKVTGEGRMKESITRRRQAPSIATIGSTCDLNLKIPGNWFQMVSAQERLTRTFTRSSHTYTRTERTEISKTRGGETKREVRVEESTQVGGDPFPAVFGDFLGRERLGSFGSITRQQEGEASSQDMTAQVTSPSGKTEAAEIVEGEDSAYSVRFVPQEMGPHTVAVKYRGQHVPGSPFQFTVGPLGEGGAHKVRAGGTGLERGVAGVPAEFSIWTREAGAGGLSIAVEGPSKAEIAFEDRKDGSCGVSYVVQEPGDYEVSIKFNDEHIPDSPFVVPVASLSDDARRLTVTSLQETGLKVNQPASFAVQLNGARGVIDARVHTPSGAVEECYVSELDSDKHTIRFIPHENGVHSIDVKFNGAHIPGSPFKIRVGEQSQAGDPGLVSAYGPGLEGGTTGVSSEFIVNTQNAGSGALSVTIDGPSKVQLDCRECPEGHVVTYTPMAPGNYLIAIKYGGPQHIVGSPFKAKVTGPRLSGGHSLHETSTVLVETVTKSSSSRGASYSSIPKFSSDASKVVTRGPGLSQAFVGQKNSFTVDCSKAGTNMMMVGVHGPKTPCEEVYVKHMGNRVYNVTYTVKEKGDYILIVKWGDESVPGSPFKVNVP

SEQ ID NO: 414 - protein, 2647 aa, Macaca mulatta
MSSSHSRAGQSAAGAAPGGGADTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVNNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPAGQKGTVEPQLEARGDSTYRCTYQPTMEGVHTVHVTFAGVPIPRSPYTVTVGQACNPSACRAVGRGLQPKGVRVKETADFKVYTKGAGSGELKVTVKGPKGEERVKQKDLGDGVYGFEYYPTVPGTYIVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSDDIRLSPFMADIRDAPQDFHPDRVKARGPGLEKTGVAVNKPAEFTVDAKHGGKAPLRVQVQDNEGCPVEALVKDNGNGTYSCSYVPRKPVKHTAMVSWGGVSIPNSPFRVNVGAGSHPNKVKVYGPGVAKTGLKAHEPTYFTVDCAEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLTKGDAVRDVDIIDHHDNTYTVKYTPVQQGPVGVNVTYGGDPIPKSPFSVAVSPSLDLSKIKVSGLGEKVDVGKDQEFTVKSKGAGGQGKVASKIVGPSGAAVPCKVEPGLGADNSVVRFVPREEGPYEVEVTYDGVPVPGSPFPVEAVAPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEVGQFQVDCSSAGSAELTIEICSEAGLPAEVYIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDRGDGTYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYIICVRFGGEHVPNSPFQVTALAGDQPSVQPPLRSQQLAPQYTYAQGGQQTWAPERPLVGVNGLDMTSLRPFDLVIPFTIKKGEITGEVRMPSGKVAQPAITDNKDGTVTVRYAPSEAGLHEMDIRYDNMHIPGSPLQFYVDYVNCGHVTAYGPGLTHGVVNKPATFTVNTKDAGEGGLSLAIEGPSKAEISCTDNQDGTCSVSYLPVLPGDYSILVKYNEQHIPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKSHEAEIVEGENHTYCIRFVPAEMGTHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGSPAEFIVNTSNAGAGALSVTIDGPSKVKMDCQECPEGYRVTYTPMAPGSYLISIKYGGPYHIGGSPFKAKVTGPRLVSNHSLHETSSVFVDSLTKATCAPQHGAPGPGPADAAKVVAKGLGLSKAYIGQKSSFTVDCSKAGNNMLLVGVHGPRTPCEEILVKHVGSRLYSVSYLLKDKGEYTLVVKWGDEHIPGSPYRVVVP

SEQ ID NO: 415 - protein, 2646 aa, Canis lupus familiaris
MSSSHSRAGQSAAGAAPGGGADTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVNNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVVIQDPTGQKGTVEPQLEARGDSTYRCSYQPTMEGVHTVHVTFAGVPIPRSPYTVTVGQACNPGACRAVGRGLQPKGVRVKETADFKVYTKGAGSGDLKVTVKGPKGEERVKQKDLGDGVYGFEYYPMVPGTYTVTITWGGQNIGRSPFEVKVGTECGNQKVRAWGPGLEGGVVGKSADFVVEAIGDDVGTFGFSVEGPSQAKIECDDKGDGSCDVRYWPQEAGEYAVHVLCNSEDIRLSPFMADIREAPQDFHPDRVKARGPGLEKTGVAVNKPAEFTVDAKHGGKAALRVQVQDNEGCPVDATVKDNGNGTYSCSYVPRKPVKHTAMVSWGGVSIPNSPFRVNVGAGSHPNKVKVYGPGVAKTGLKAHEPTYFTVDCTEAGQGDVSIGIKCAPGVVGPTEADIDFDIIRNDNDTFTVKYTPRGAGSYTIMVLFADQATPTSPIRVKVEPSHDASKVKAEGPGLSRTGVELGKPTHFTINAKAAGKGKPDVQFSGLAKGDAVRDVDIIDHHDNTYTVKYTPVQQGPVGINVTYGGDPIPKSPFSVGVSPSLDLSKIKVSGLGEKVDVGKDQEFTVKSKGAGGQGKVASKITGPSGTAVPCKVEPGLGADNSVVRFVPREEGPYEVEVTYDGVPVPGSPFPVEALPPTKPSKVKAFGPGLQGGSAGSPARFTIDTKGAGMGGLGLTVEGPCEAQLECLDNGDGTCSVSYVPTEPGDYNINILFADTHIPGSPFKAHVVPCFDASKVKCSGPGLERATAGEAGQFHVDCSSAGSAELTIEIRSEAGLPAEVHIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDCGDGTYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGEEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPAAQPPLRPQQLAPPYTYAQGGQQTWAPERPLMGVNGLDVTSLRPFDLVIPFTIKKGEITGEVRMPSGKVAQPAITDNKDGTVTVRYAPSEAGLHEMDIRYDNMHIPGSPLQFYVDYVNCGHVTAYGPGLTHGVVNKPAVFTVNTKDAGEGGLSLAIEGPSKAEISCTDNQDGTCSVSYLPVLPGDYSILVKYNEQHIPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCNLSLKIPEISIQDMTAQVTSPSGKTHEAEIVEGENHTYCIRFVPAEMGMHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGSPAEFIVNTSNAGAGALSVTIDGPSKVKMDCQECPEGYRVTYTPMAPGSYLISIKYGGPYHIGGSPFKAKVTGPRLVSNHSLHETSSVFVDSLTKTASAPQHGALAGSTDASKVLAKGLGLSKAYVGQKSSFTVDCSKAGNNMLLVGVHGPRTPCEEILVKHVGNRLYNVSYLLKDKGEYTLVVKWGDEHIPGSPYRVLVP

SEQ ID NO: 416 - protein, 2651 aa, Felis catus
MSSSHSRAGQSAAGAAPGGGTDTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVNNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVDVVIQDPTGQKGAVEPQLEARGDSTYRCSYQPTMEGVHTVHVTFAGVPIPRSPYTVTVGQACNPGACRAVGRGLQPKGVRVKETADFKVYTKGAGSGELKVTVKGPKGEERVKQKDLGDGVYGFEYYPMVPGTYTVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIREAPQDFHPDRVKARGPGLEKTGVAVNKPAEFTVDAKHGGKAPLRIQVQDNEGCPVEASVKDNGNGTYSCSYVPRKPVKHTAVVSWGGVNVPNSPFRVNVGAGSHPNKVKVYGPGVAKTGLKAHEPTYFTVDCTEAGQGDVSIGIKCAPGVVGPTEADIDFDIIRNDNDTFTVKYTPRGAGSYTIMVLFADQATPTSPIRVKVEPSHDASKVKAEGPGLSRTGIELGKPTHFTVNAKAAGKGKLDVQFTGLAKGDVARDVDIIDHHDNTYTVKYTPVQQGPVGINVTYGGDPIPKSPFSVGVSPSLDLSKIKVSGLGEKVDVGKDQEFTVKSKGAGGQGKVASKITGPSGTVVPCKVEPGLGADNSVVRFVPREEGPYEVEVTYDGVPVPGSPFPLEALPPTKPSKVKAFGPGLQGGSAGSPARFTIDTKGAGMGGLGLTVEGPCEAQLECLDNGDGTCSVSYVPTEPGDYNINILFADTHIPGSPFKAHVVPCFDASKVKCSGPGLERATAGEAGQFHVDCSSAGSAELTIEIRSEAGLPAEVHIQDHGDGTHTITYIPLCPGAYTVTIKYGGQPVPNFPSKLQVEPAVDTSGVQCYGPGIEGQGVFREATTEFSVDARALTQTGGPHVKARVANPSGNLTETYVQDCGDGTYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLETGLVEPVDVVDNADGTQTVNYVPSREGPYSISVMYGEEEVPRSPFKVKVLPTHDASKVKASGPGLNTTGVPASLPVEFTIDAKDAGEGLLAVQITDPEGKPKKTHIQDNQDGTYTVAYVPDVTGRYTILIKYGGDEIPFSPYRVRAVPTGDASKCTVTVSIGGHGLGAGIGPTIQIGEETVITVDTKAAGKGKVTCTVCTPDGSEVDVDVVENEDGTFDIFYTAPQPGKYVICVRFGGEHVPNSPFQVTALAGDQPTAQPPLRPQQLAPPYTYPQGGQQTWAPERPLMGVNGLDVTSLRPFDLVIPFTIKKGEITGEVRMPSGKVAQPAITDNKDGTVTVRYAPSEAGLHEMDIRYDNMHIPGSPLQFYVDYVNCGHVTAYGPGLSHGVVNKPAVFTVNTKDAGEGGLSLAIEGPSKAEISCTDNQDGTCSVSYLPVLPGDYSILVKYNEQHIPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKSHEAEIVEGENHTYCIRFVPAEMGMHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGVYLIDVKFNGTHIPGSPFKIRVGEPGHGGDPGLVSAYGAGLEGGVTGSPAEFIVNTSNAGAGALSVTIDGPSKVKMDCQECPEGYRVTYTPMAPGSYLISIKYGGPYHIGGSPFKAKVTGPRLVSNHSLHETSSVFVDSLTKTASAPQHGAPGAGSTDASKVLAKGLGLSKAYAGQKSSFTVDCSKAGNNMLLVGVHGPRTPCEEILVKHVGSRLYSVSYLLKDKGEYTLVVKWGDEHIPGSPYRVLVP

SEQ ID NO: 417 - protein, 2633 aa, Ovis aries
  misc_feature (31)..(31): Xaa can be any naturally occurring amino acid
  misc_feature (181)..(181): Xaa can be any naturally occurring amino acid
SAHWHARAPSKAAGSWRAGGLLAQCPISSGXEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLXLPITNSSRDWQSGRALGALVDSCAPGLCPDWDSWDASKPVNNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEVRQPAAPSHPRPKGPWYVPEVTGTHKVTVLFAGQHIAKSPFEVYVDKSQGDASKVTAQGPGLEPSGNIANKTTYFEIFTAGERMGEVEVVIQDPAGHKGTVEPQLEARGDSTYRCSYQPSVEGVHMVHVTFAGVPIPRSPYTVTVGQACNPGACHAVGRGLQPKGVRVKETADFKVYTKGAGSGELKVTVKGPKGEERVKQKDLGDGVYGFEYYPMIPGTYTVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIRDAPQDFHPDRVKARGPGLEKTGVAVNKPAEFTVDAKHGGKAPLKVQVQDNEGCPVEATVKDNGNGTYSCSYVPRKPVKHTAMVSWGGVSIPNSPFRVNVGAGSHPNKVKVYGPGVAKTGLKAHEPTYFTVDCTEAGQGDVSIGIKCAPGVVGPAEADIDFDIIRNDNDTFTVKYTPRGAGSYTIMVLFADQATPTSPIRVKVEPSHDASKVKAEGPGLSRTGVELGKPTHFTVNTKAAGKGKLDVQFSGLAKGDAVRDVDIIDHHDNTYTVKYTPVQQGPVGINVTYGGDAIPKSPFSVGVSPSLDLSKIKVSGLGEKVDVGKDQEFTVKSKGAGGQGKVLSKIVGPSGAAVPCKVEPGLGADNSVVRFVPREEGPYEVEVTYDGIPVPGSPFSLEAVPPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDPSKVKCSGPGLERATAGEAGQFHVDCSSAGSAELTIEIRSEAGLPAEVHIQDHGDGTHTITYIPLCPGAYTVTIKYGGQPVPNFPSKLQVEPAVDTSGIQCYGPGIEGQGVFREATTEFSVDARALTQTGGPHVKARVANPSGNLTETYVQDCGDGTYKVEYTPYEEGLHSVDVTYDGSPVPSSPFQVPVTEGCDPSRVRVHGPGIQSGTTNKPNKFTVETRTRGAGTGGLGLAVEGPSEAKMSCMDNKDGSCSVEYVPYEAGTYSLNVTYGGHQVPGSPFKVPVHDVTDASKVKCSGPGLSPGMVRANLPQSFQVDTSKAGMAPLQVKVQGPKGLVEPVDVVDNADGTQTVNYVPSREGPYSISVLYGDEEVPRSPFKVKVLPTHDASKVKASGPGLNTTGVPASLPVEFTIDAKDAGEGLLAVQITDPEGKPKKTHIQDNHDGTYTVAYVPDVTGRYTILIKYGGDEIPFSPYRVRAVPTGDASKCTVTGAGIGPTIQIGEETVITVDTKAAGKGKVTCTVCTPDGSEVDVDVVENEDGTFDIFYTAPQPGKYVICVRFGGEHVPNSPFQVTALAGDQPTAQPPLRPQQLAPPYTYAQGGQQTWAPERPLVGVNGLDVSSLRPFDLVIPFTIKKGEVTGEVRMPSGKVAQPAITDNKDGTVTVRYAPSEAGLHEMDIRYDNMHIPGSPLQFYVDYVNCGHVTAYGPGLTHGVVNKPAIFTVNTKDAGEGGLSLAIEGPSKAEISCTDNQDGTCSVSYLPVLPGDYSILVKYNEQHIPGSPFTARVTGDDSMRMSHLKVGSAADIPINISETDLSLLTATVVPPSGREEPCLLKRLRNGHVGISFVPKETGEHLVHVKKNGQHVASSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGSPFSVKVTGEGRVKESITRRRRAPSVANVGSHCDLSLKIPEISIQDMTAQVTSPSGKSHEAEIVEGENHTYCIRFVPAEMGMHTVSVKYKGRQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGIYLIDVKFNGTHIPGSPFKIRVGEPGHGGDPGLVSAYGAGLEGGITGSPAEFIVNTSNAGAGALSVTIDGPSKVKMDCHECPEGYRVTYTPMAPGSYLISIKYGGPYHIAGSPFKARVTGHRLVSNHSLHETSSVFVDSLTKTATVPQHSAPGPGPTDASKVLAKGVGLSKAYMGQKSSFTVDCSKAGNNMLLVGVHGPRTPCEEILVKHVGSRLYSVSYLLKDKGEYTLVVKWGDEHIPGSPYRVLVP

SEQ ID NO: 418 - protein, 2646 aa, Equus caballus
MSSSHSRAGQSAAGAALGAGADTRDAEMPATEKDLAEDAPWKKIQQNTFTRWCNEHLKCVSKRIANLQTDLSDGLRLIALLEVLSQKKMHRKHNQRPTFRQMQLENVSVALEFLDRESIKLVSIDSKAIVDGNLKLILGLIWTLILHYSISMPMWDEEEDEEAKKQTPKQRLLGWIQNKLPQLPITNFSRDWQSGRALGALVDSCAPGLCPDWDSWDASKPVNNAREAMQQADDWLGIPQVITPEEIVDPNVDEHSVMTYLSQFPKAKLKPGAPLRPKLNPKKARAYGPGIEPTGNMVKKRAEFTVETRSAGQGEVLVYVEDPAGHQEEAKVTANNDKNRTFSVWYVPEVTGTHKVTVLFAGQHIAKSPFEVYVDKSQGDASKVTAQGPGLEPSGNIANKTTYFEIFTAGAGTGEVEVMIQDPAGQKGTVEPQLEARGDSTYRCSYQPTMEGIHMVHVTFAGVPIPRSPYAVTVGQACNPGACRAVGRGLQPKGVRVKETADFKVYTKGAGSGELKVTVKGPKGEERVKQKDLGDGVYGFEYYPMVPGTYTVTITWGGQNIGRSPFEVKVGTECGNQKVRAWGPGLEGGVVGKSADFVVEAIGDDVGTLGFSVEGPSQAKIECDDKGDGSCDVRYWPQEAGEYAVHVLCNSEDIRLSPFMADIREAPQDFHPDRVKARGPGLEKTGVAVNKPAEFTVDAKHGGKAPLRVQVQDNEGCPVEASVKDNGNGTYSCSYVPRKPVKHTAVVSWGGVSIPNSPFRVNVGAGSHPNKVKVYGPGVAKTGLKAHEPTYFTVDCTEAGQGDVSIGIKCAPGVVGPTEADIDFDIIRNDNDTFTVKYTPRGAGSYTIMVLFADQATPTSPIRVKVEPSHDASKVKAEGPGLSRTGVELGKPTHFTVNAKAAGKGKLDVQFSGLAKGDAVRDVDIIDHHDNTYTVKYTPVQQGPVGVNVTYGGDPIPKSPFSVGVSPSLDLSKIKVSGLGEKVDVGKDQEFTIKSKGAGGQGKVASKIVGPSGTPVPCKVEPGLGADNSVVRFVPREEGPYEVEVTYDGVPVPGSPFPLEAVPPTKPSKVKAFGPGLQGGSAGSPARFTIDTKGAGTGGLGLTVEGPCEAQLECLDNGDGTCSVSYVPTEPGDYNINILFADTHIPGSPFKAHVVPCFDASKVKCSGPGLERATAGEAGQFHVDCSSAGSAELTIEIRSEAGLPAEVHIQDHGDGTHTITYIPLCPGAYTVTIKYGGQPVPNFPSKLQVEPAVDTSGIQCYGPGIEGQGVFREATTEFSVDARALTQTGGPHVKARVANPSGNLTETYVQDCGDGTYKVEYTPYEEGLHSVDVTYDGSPVPSSPFQVPVTEGCDPSRVRVHGPGIQSGTTNKPNKFTVETRGAGTGGLGLAVEGPSEAKMSCMDNKDGSCSVEYIPYEAGTYSLNVTYGGHQVPGSPFKVPVHDVTDASKVKCSGPGLSPGMVRANLPQSFQVDTSKAGVAPLQVKVQGPKGLVEPVDVVDNADGTQTVNYVPSREGPYSISVLYGEEEVPRSPFKVKVLPTHDASKVKASGPGLNTTGVPASLPVEFTIDAKDAGEGLLAVQITDPEGKPKKTHIQDNHDGTYTVAYVPDLTGRYTILIKYGGDEIPFSPYRVRAVPTGDASKCTVTVSIGGHGLGAGIGPTIQIGEETVITVDTKAAGKKVTCTVCTPDGSEVDVDVVENEDGTFDIFYTAPQPGKYVICVRFGGEHVPNSPFQVTALAGDQPTAQPPLRPQQLAPPYTYAQGGQQTWAPERPLVGVNGLDVTSLRPFDLVIPFTIKKGEITGEVRMPSGKVAQPAITDNKDGTVTVRYAPSEAGLHEMDIRYDNMHIPGSPLQFYVDYVNCGHVTAYGPGLTHGVVNKPAVFTVNTKDAGEGGLSLAIEGPSKAEISCTDNQDGTCSVSYLPVLPGDYSILVKYNEQHIPGSPFTARVTGDDSMRMSHLKVGSAADIPINVSETDLSLLTATVVPPSGREEPCLLKRLRNGHVGISFVPKETGEHLVHVKKNGQHVANSPIPVVISQSEIGDASRVRVSGQGLHEGHTFEPAEFIIDTRDAGYGGLSLSIEGPSKVDINTEDLEDGTCRVTYCPTEPGNYIINIKFADQHVPGDPFSVKVTGEGRVKESITRRRRAPSVANVGSHCDLSLKIPEISIQDMTAQVTSPSGKSHEAEIVEGENHTYCIRFVPAEMGMHTVSVKYKGQHVPGSPFQFTVGPLGEGGAHKVRAGGPGLERAEAGVPAEFSIWTREAGAGGLAIAVEGPSKAEISFEDRKDGSCGVAYVVQEPGDYEVSVKFNEEHIPDSPFVVPVASPSGDARRLTVSSLQESGLKVNQPASFAVSLNGAKGAIDAKVHSPSGALEECYVTEIDQDKYAVRFIPRENGIYLIDVKFNGTHIPGSPFKIRVGEPGHGGDPGLVSAYGAGLEGGVTGSPAEFIVNTSNAGAGALSVTIDGPSKVKMDCQECPEGYRVTYTPMAPGSYLISIKYGGPYHIGGSPFKAKVTGPRLVSNHSLHETSSVFVDSLTKTASVPQHGAPGPGPTDASKVLAKGLGLSKAYVGQKSSFTVDCSKAGNNMLLVGVHGPRTPCEEILVKHVGSRLYSVSYLLKDKGEYTLVVKWGDEHIPGSPYRVVVP

SEQ ID NO: 419 - protein, 294 aa, Oryctolagus cuniculus
GTRLNGAKGKIDAKVHSPSGAVEECHVSELEPDKYAVRFIPHENGIHTIDVKFNGSHVVGSPFKVRVGEPGQAGNPALVSAYGAGLEGGTTGIQSEFFINTTRAGPGTLSVTIEGPSKVKMDCQETPEGYKVMYTPMAPGNYLIGVKYGGPNHIVGSPFKAKVTGQRLVGPGSTNETSSILVESVTRSSTETCYSAIPKASSDASKVTSKGAGLSKAFVGQKSSFLVDCSKAGSNMLLIGVHGPTTPCEEVSMKHVGSQQYNVTYVVKERGEYVLAVKWGEEHIPGSPFHVTVP

SEQ ID NO: 420 - protein, 2602 aa, Rattus norvegicus
MPVTEKDLAEDAPWKKIQQNTFTRWCNEHLKCVNKRIGNLQTDLSDGLRLIALLEVLSQKRMHHKYHQRPTFRQMKLENVSVALEFLDHESIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPRKPVDNAREAMQQADDWLGVPQVITPEEIIHPDVDEHSVMTYLSQFPKAKLKPGAPLKPKLNPKKARAYGRGIESTGNMVKQPAKFTVDTISAGQGDVMVFVEDPEGNKEEARVTPDSDKNKTYSVEYLPKVTGLHKVIVLFAGQHISKSPFEVNVDKAQGDASKVTAKGPGLETTGNIANKPTYFDIYTAGAGVGDIGVEVEDPQGKNSVELLVEDRGNQVYRCVYKPLQPGPHVVKVSFAGDAIPKSPFGVQIGEACNPNACRASGRGLQPKGVRIRETADFKVDTKAAGSGELAVTVKGPKGLEELVKQKGFLDGVYSFEYYPSTPGKYSIAVTWGGHHIPKSPFEVQVGPEAGMQKVRAWGPGLHGGIVGRSADFVVESIGSEVGTLGFAIEGPSQAKIEYDDQNDGSCDVKYWPKEPGEYAVHIMCDDEDIKDSPYMAFIHPATGDYNPDLVQAYGPGLEKTGCTINNPAEFIVDPKDAGNAPLKILAQDGEGQPIDIQMKSRMDGTYVCSYTPVKAIKHTIAVVWGGVNIPHSPYRVNIGQGSHPQKVKVFGPGVERSGLKANEPTHFTVDCTEAGEGDVSVGIKCDARVLSDDEEDVDFDIIHNANDTFTVKYVPPAPGRYTIKVLFASEEIPASPFRVKVDPSHDASKVKAEGPGLSKAGVENGKPTHFTVHTKGAGKAPLNVQFSSPVPGEAVKDLDIIDNYDYSHTVKYTPTQQGNMQVLVTYGGDPIPKSPFTVGVAAPLDLSKIKINGLENRVEVGKDQEFAIDTNGAGGQGKLDVTILSPSRKVVPCLVAPVAGRECSTAKFIPREEGLFAVDVTYDGHPVPGSPYTVEASLPPDPTKVKAHGPGLEGGLVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEPGILCVDCSEAGPGTLGLEAVSDSGAKAEVSIQNNKDGSYAVTYVPLTAGMYTLTMKYGGELVPQFPTWVKVEPTVDTSGIKAFGPGIEGKDVFREATTDFTVDARPLTQVGGDHIKAHIANPSGASTECFVKDNADGTYQVEYTPFEKGFHVVEVTYDDAPIPNSPFKVAVNEGCQPSRVHAQGPGLKEAFTNKPNVFTVVTRGAGIGGLGITVEGPSESKINCRDNKDGSCSAEYIPFAPGDYDVNITYGGVHIPGSPFRVPSKDVVDPSKVKIAGPGLSSCVRACIPQSFTVDTSKAGLAPLEVRVMGPRGLVEPVDVVDNGDGTHTVTYTPSQEGPYIVSVKYADEEIPRSPFKVKVLPTYDASKVTASGPGLSAYGVPASLPVEFAIDARDAGEGLLAVQITDQEGKPQRATVHDNKDGTYAVTYIPDKTGRYMIGVTYGGDNIPLSPYRIRATQTGDASKCLATGPGIAPTVKTGEEVGFVVDAKTAGKGKVTCVILTPDGTEAEADVIENEDGTYDIFYTAAKPGTYVIYVRFGGVDIPNSPFTVMATDGEVTAMEEAPVNACPPGFRPWVTEEAYVPVSDMNGLGFKPFDLVIPFAVRKGEITGQVHMPSGKKATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSTLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGHVTEAEIVPVGKNSHCVRFVPQEMGVHTVSVKYRGQHVTGSPFQFTVGPLGEGGAHKVRAGGPGLERGEAGIPAEFSIWTREAGAGGLSIAVEGPSKAEITFDDHKNGSCGVSYIAQEPGNYEVSIKFNDEHIPDSPYLVPVIAPSDDARCLTVLSLQESGLKVNQPASFAIRLNGAKGKIDAKVHSPSGAVEECHVSELEPDKYAVRFIPHENGIHTIDVKFNGSHVVGSPFKVRVGEPGQAGNPALVSAYGAGLEAGTTGIQSEFFINTTQAGPGTLSVTIEGPSKVKMDCQEIPEGYKVMYTPMAPGNYLISVKYGGPNHISRSPFKAKVTGQRLVTPGSANETSSILVESVTRSSTETCYSAIPKSSSDASKVTSKGAGLSKAFVGQKSSFLVDCSKAGSNMLLIGVHGPTTPCEEVSMKHVGKQQYNVTYVVKEKGDYVLAVKWGEEHIPGSPFHVTVP

SEQ ID NO: 421 - protein, 2506 aa, Taeniopygia guttata
DSKAIVDGNLKLILGLIWTLILHYSISMPVWEDEGDDDAKKQTPKQRLLGWIQNKIPYLPITNFNQNWQDGKALGALVDSCAPGLCPDWETWDPKKPVDNAREAMQQADDWLGVPQVITPEEIIHPDVDEHSVMTYLSQFPKAKLKPGAPLKPKLNPKKARAYGRGIEPHGNMVKQPAIFTVDTISAGQGDLMVFIEDPEGNREEAKITPSSDKNKTYSVQYVPRVTGPHKVSVLFAGQHISKSPFEVNVDKAQGDASKVTAKGPGLEAAGNIANKPTYFDLYTAGAGVGDVIVEVEDPQGRSLAEVVVEDKGNQVYRCTYKPVQAGPHIVKVTFAGEAIPKTPCTVLIGEACNPNACRATGRGLQPKGVRIRETADFKVDTRAAGSGDLGVIIKGPKGLEELVKQKGFMDGIYAFEYYPATPGKYVVTITWGGQNIPKSPFEVQVGHEAGPQKVRAWGPGLHEGVVGKSADFVVESIGTEVGSLGFAIEGPSQAKIECDDKNDGSCDVKYWPKEPGEYAVHIMCDDEDIKDSPYMAFIRPASGDFNADKVKAYGPGLERTGCIVNNPAEFTVETKDAGKAPLKMYAQDGEGNPIDIQIKSKPDGVFACSYVPVKPIKHTISVVWGGANVPNSPFRVLIGQGSHPQKVKVFGPGVERTGLKASEPTHFTVDCTDAGEGDVSVGIKCDARVVSSEEEDIDFDIIHNANDTFTVKYSPPAAGRYTIKVLFAGEEIPASPFRVKVDPSHDASKVKAEGPGLNKTGVENGKPTHFTVFTKGAGKAPLDVQFSSSVPGEAVMDLDIIDNYDYSHTIRYTPIQQGPMKVLVTYGGDPIPKSPFTVGVAAPLDLSKVIVNGLENRVEVGKDQEFVIDTKGAGGQGKLEVNISSPMRKAVPCLVEPVLGKECSTAKYIPREEGLYVVDVSYDGNPIPGSPYTVEATLPPDPSKVKAHGPGLRGGLVGKPAQFTIDTKGAGTGGLGLTVEGPCEAKIECSDNGDGTCSVSYLPTKPGEYFVNILFEEVHIPGSPFKADIEMPFDVSKVIATGPGLERGKVGEAGLLNVDCTEAGPGDLRVDMVSDTGSKAEVQIDDNKDGTYVVTYVPLSAGMYTIKMRYGGEQVPKFPARVKVEPAVDTSRVKVFGPGVEGKDVFREATTEFTVDARPLTKAGGDHIRTQITSPSGSPTDCLIQDNADGTYSVEYTPFEKGPHSVSVTYDGVPVPNSPFRVNVAEGCHPSRVKAQGPGLTEAFTNQPNAFSVVTRGAGIGGLGITVEGPSESKISCKDNKDGSCSAEYIPYVPGDYDVNITYGGEHIPGSPFKVPVKDVVDPSKVKIAGPGLGTAVRAKIPQSFTVDTSKAGIAPLEVVVTGPRGVVGPVNVVDNGDGTHTVVYTPMQEGPYMITVKYADEEIPRSPFKVKVLPTYDASKVTASGPGLSSYGILASLPVEFAVDAKDAGQGLLAVQITDQEGKPKRVDIHDNKDGTYMVTYVPDKTGRYTIGVKYGGDDIPASPYRIRASPAGDASKCLATGPGIAPTVKTGEEVGFVVDAKSAGKGKVTCTVLTPDGTEAEADVVENEDGTYDIFYTAAKPGTYVIYVRFGGVDIPNSPFTVMAVDADDVAAQSQEPVGASPPGFRPWVTEEAYVPVGDMNGMGFRPFDMVIPFAVRKGEITGEVHMPSGKMDTPDIVDNKDGTVTVKYAPTEVGLHEMHIKYMGNHIPESPLQFYVNYPNSGSVSAYGPGLIYGIANKPATFTIVTEDAGEGGLDLAIEGPSKAEISCIDNKDGTCTVTYLPTLPGNYSILVKYNDKHIPGSPFTAKITDDNRRRSQVKLGSAADFMLDINETDLSLLTASIKAPSGRDEPCLLKRLPNNHIGISFIPREVGEHLVSIKKNGSHVPNSPVTIMVVQSEIGDARRARVFGRGLVEGRTFEMCDFIVDTRDAGYGGISLAVEGPSKVEIQTEDLEDGTCKVSYFPTVPGVYIVSTKFADEHIPGSPFSVKISGEGRVKESITRTRRAPSVATVGSICDLNLKIPEIDCADMTAQVTSPSGRNFDAEIVECDKNTYCVRFVPQEMGVHTVDVKYKGQPVPGSPFQFTVGPLGEGGAHKVRAGGPGLERGETGVPAEFSIWTREAGAGGLSIAVEGPSKAEITFDDHKDGSCGASYIVQEPGNYEVSIKFNDEHIPESPYLVPVIAPSDDARRLTVTSLQESGLKVNQPASFAIRLNGAKGKIDAKVHSPSGAVEECHVSELEPDKYAVRFIPHENGIHTIDVKFNGSHVVGSPFKVRVGEPGQAGNPALVTAYGSGLESGTTGLQSEFFINTTKAGPGTLSVTIEGPSKVKMDCQETPEGYKVMYTPMAPGNYLIGVKYGGPNHIVGSPFKAKVTGQRLVSPGSANETSSILVESVTRSSTETCYSAIPKSTSDASKVVSRGAGLSKAFVGQKSSFSVDCSKAGSNMLLVGVHGPTIPCEEVSIKHLGSHQYNVTYVVKERGDYVLAVKWGDEHIPGSPFHVTVP

SEQ ID NO: 422 - protein, 2633 aa, Callithrix jacchus
MPVTEKDLAEDAPWKKIQQNTFTRWCNEHLKCVNKRIGNLQTDLSDGLRLIALLEVLSQKRMYRKYHQRPTFRQMQLENVSVALEFLDRENIKLVSIDSKAIVDGNLKLILGLVWTLILHYSISMPVWEDEGDDDAKKQTPKQRLLGWIQNKIPYLPITNFNQNWQDGKALGALVDSCAPGLCPDWESWDPQKPVDNAREAMQQADDWLGVPQVITPEEIIHPDVDEHSVMTYLSQFPKAKLKPGAPLKPKLNPKKARAYGRGIEPTGNMVKQPAKFTVDTISAGQGDVMVFVEDPEGNKEEAQVTPDSDKNKTYSVEYLPKVTGLHKVTVLFAGQHISKSPFEVNVDKAQGDASKVTAKGPGLEAAGNIANKPTYFDIYTAGAGVGDIGVEVEDPQGKNSVELLVEDKGNQVYRCVYKPMQPGPHVVKVFFAGDTIPKSPFVVQVGEACNPNACRASGRGLQPKGVRIRETADFKVDTKAAGSGELSVAVKGPKGLEELVKQKGFLDGVYAFEYYPSTPGRYSIAITWGGHHIPKSPFEVQVGPEAGMQKVRAWGPGLHGGIVGRSADFVVESIGSEVGSLGFAIEGPSQAKIEYDDQNDGSCDVKYWPKEPGEYAVHIMCDDEDIKDSPYMAFIHPATGDYNPDLVRAYGPGLEKSGCIVNNLAEFTVDPKDAGKAPLKIFAQDGEGQPIDIQMKSRMDGTYACSYSPVKAIKHTIAVVWGGVNIPHSPYRVNIGQGSHPQKVKVFGPGVERSGLKANEPTHFTVDCSEAGEGDVSVGIKCDARVLSEDEEDVDFDIIHNANDTFTVKYVPPAAGRYTIKVLFASQEIPASPFRVKVDPSHDASKVKAEGPGLSKAGVENGKPTHFTVYTKGAGKAPLNVQFNSPLPGDAVKDLDIIDNYDYSHTVKYTPTQQGNMQVLVTYGGDPIPKSPFTVGVAAPLDLSKIKLNGLENRVEVGKDQEFTIDTRGAGGQGKLDVTILSPSRKVVPCLVTPVTGRESSTAKFIPREEGLYAVDVTYDGHPVPGSPYAVEASLPPDPTKVKAHGPGLKGGFVGKPAEFTIDTKGAGTGGLGLTVEGPCEAKIECSDNGDGTCSVSYLPTKPGEYFVNILFEEVHIPGSPFKADIEMPFDPSKVVASGPGLEHGKVGEVGLLSVDCSEAGPGALGLEAVSDSGTKAEVSIQNNKDGTYAVTYVPLTAGMYTLTMKYGGELVPHFPTRVKVEPAVDTSRIKVFGPGIEGKDVFREATTDFTVDSRPLTQVGGDHIKAHIANPSGASTECFVTDNADGTYQVEYTPFEKGLHVVEVTYDDVPIPNSPFKVAVTEGCQPSRVQAQGPGLKEAFTNKPNVFTVVTRGAGIGGLGITVEGPSESKINCRDNKDGSCSAEYIPFAPGDYDVNITYGGAHIPGSPFRVPVKDVVDPSKVKIAGPGLGSGVRARVLQSFTVDSSKAGLAPLEVRVLGPRADEMDSQSWRSPLKALSEFFKGDPKGDFNETGLVEPVNVVDNGDGTHTVTYTPSQEGPYMVSVKYADEEIPRSPFKVKVLPTYDASKVTASGPGLSSYGVPASLPVDFAIDARDAGEGLLAVQITDQEGKPKRAIVHDNKDGTYAVTYIPDKTGRYMIGVTYGGDNIPLSPYRIRATQTGDASKCLATGPGIASTVKTGEEVGFVVDAKTAGKGKVTCTVLTPDGTEAEADVIENEDGTYDIFYTAAKPGTYVIYVRFGGVDIPNSPFTVMATDGEVTAVEEAPVNACPPGFRPWVTEEAYVPVSDMNGLGFKPFDLVIPFAVRKGEITGEVHMPSGKTATPEIVDNKDGTVTVRYAPTEVGLHEMHIKYMGSHIPESPLQFYVNYPNSGSVSAYGPGLVYGVANKTATFTIVTEDAGEGGLDLAIEGPSKAEISCIDNKDGTCTVTYLPTLPGDYSILVKYNDKHIPGSPFTAKITDDSRRCSQVKLGSAADFLLDISETDLSSLTASIKAPSGRDEPCLLKRLPNNHIGISFIPREVGEHLVSIKKNGNHVANSPVSIMVVQSEIGDARRAKVYGRGLSEGRTFEMSDFIVDTRDAGYGGISLAVEGPSKVDIQTEDLEDGTCKVSYFPTVPGVYIVSTKFADEHVPGSPFTVKISGEGRVKESITRTSRAPSVATVGSICDLNLKIPEINSSDMSAHVTSPSGRVTEAEIVPMGKNSHCVRFVPQEMGVHTVSVKYRGQHVTGSPFQFTVGPLGEGGAHKVRAGGPGLERGEAGVPAEFSIWTREAGAGGLSIAVEGPSKAEITFDDHKNGSCGVSYIAQEPGNYEVSIKFNDEHIPESPYLVPVIAPSDDARRLTVMSLQESGLKVNQPASFAIRLNGAKGKIDAKVHSPSGAVEECHVSELEPDKYAVRFIPHENGVHTIDVKFNGSHVVGSPFKVRVGEPGQAGNPALVSAYGAGLEGGTTGIQSEFFINTTRAGPGTLSVTIEGPSKVKMDCQETPEGYKVMYTPMAPGNYLISVKYGGPNHIVGSPFKAKVTGQRLVSPGSANETSSILVESVTRSSTETCYSAIPKASSDASKVTSKGAGLSKAFVGQKSSFLVDCSKAGSNMLLIGVHGPTTPCEEVSMKHVGNQQYNVTYVVKERGDYVLAVKWGEEHIPGSPFHVTVP

SEQ ID NO: 423 - protein, 2773 aa, Danio rerio
MMSNNTYYDQQLPPQYYQGTDNGEDGDEEMPATEKDLAEDAPWKKIQQNTFTRWCNEHLKCLNRKILDLQKDLTDGLKLIGLLEVLSQKKMYRKYHARPNFRQMKLENVSVALEFLEREHIKLVSIDSKAIVDGNLKLILGLIWTLILHYSISMPMWEDEDDEDARKLTPKQRLLGWIQNKVPQLHINNFHRDWRDGKALGALVDNCAPGLCPDWETWDPSQPVENAREAMQQADDWLGVPQVIAPEEIVDPNVDEHSVMTYLSQFPKAKLKPGAPLRPKTLHPKRAKAYGPGIEPRGNVVLKPAEFVVETVEAGLGEVLVYIEDPEGHTEEARVIPNNDRNRSYSVVYVPKVEGLHKVKVLFAGQDIDRSPFLVNVSKALGDPNKVQARGPGLEPVGNVANKPTYFDIYTAGAGAGDVGVIIVDSQGRRDTVEIILENKGDSVFRCTYGPILEGPHTIYVTFAGQQIPRSPFTVHISEAPPHGRQIGSPVHIIPQSLRTPPSEKAKKVPPPTPPKPRRPTSNPNACRAIGRGLQPKGVRVKEVADFKVYTKGAGSGELRVHVKGPTGGDEPVKVEDLGDGVYECDYYPIFCGKYIITVTWGGHAIPRSPFEVIISEDAGPQKVRAWGPGLETGMVGKSADFVVEAIGTEVGTLGFSIEGPSQAKIECDDKGDGSCDVLYWPTEPGDYAVHVICDDEDIKDSPFMAHILPAASDVFPEKVKCYGPGLEPTGCIVNKPAEFTIDARGAGRGQLQIYAQDSEGFPINIQITDNGDSTYFCVYIPIKPIKHTIIITWGEVNVPNSPFRVTIGEGSHPENVKVHGPGVEKTGLKANEPTYFTVDCSEAGQGDVSIGIKCAPGVVGPAEADIDFDIIKNDNDTFTVKYTPPGAGRYTIMVLFADQEIPISPFRIKVDPSHDANKVKAEGPGLNKTGVEVGKPTHFTIYTKGAGKATPEVHFTASGRGDAVSDFEIIDNHDYSFTVRYTALQQGNMTISVCHGGDPIPKSPFTISVAPPLDLNKVKVHGLNNKVDVGKDEEFTVNTRGAGGQGKVDVKITSPSRRPIPCKVESGASNEVHTVKYIPPEEGPYKVDISYDGNPVPGSPFTVEGVMPPDPSKVRAYGPGLKGGIVGKPAPFAIDTKGAGTGGLGLTVEGPCEAKIECQDNGDGSCSVSYLPTEPGEYSINILFADAHIPGSPFKAMVQSVFDPSKVTASGPGLERGKVNEAGSFTVDCSKAGEAELTIEIISDSGAQAEVHVQNNSDGTYSITYIPPFHGMYTITIKYGGHAVPKFPARVQVDPALDTSGIKVYGPGVEPRGVLREVTTHFIVDTRVHNKMGGNHIKVRIVNPSGANTDAYVTDKADGTYRVEYTAYEDGVHLIEVLYDDVPVPKSPFRVAVAEGCDPSRVRAYGPGLEEGLVNKPNRFTVETRGAGTGGLGLAIEGPSEAKMSCKDNKDGSCSVEYIPFTPGEYDVNITFGGLPIPGSPFRVPVRELVDPSKVKCTGPGLGSGVRAHVPQTFTVDCSKAGLAPLEVLLYGPTGMTEPVNITDNGDGTHTVVYTPAKDGPYTVCVKYADQEVPRSPFKIKVLPAHDASKVRASGPGLNASGVPASLPVEFTIDARDAGEGLLTVQILDPEGKPKKANIRDNRDGTYTVSYVPDMTGRYTITIKYGGDEIPYSPYRIHALPSGDASKCLVTVSIGGHGLGSGLGPTIQIGEETVITVDAKAAGKGKVTCKVSTPDGAELDVDVVENADGTFDIYYTAPEPGKYVITIRFGGEHIPNSPFHVVASDTIPIIEEPCDKLQLQQPYAPYQGYSPHWATEEPVTAVDIIEPVLRPFNLVIPFTVQKGEITGEVHMPSGKTASPHITDNKDGTVTVKYAPTEKGLHEMDIKYDGNHIPGSPLQFYVDAINSGHVNAYGPGLSHGMVNKSATFTIVTKDAGEGGLSLAVEGPSKAEISCKDNKDGTCTVSYLPTAPGDYNIIVKFDDKHIAGSPFTAKITGDDSMRTSQLNVGTATDVSLKITETDLSSLSATIRAPSGNEEPCLLKRLPNRHIGISFTPKEVGEHVVSVKKNGKHVTNSPFKIMVGQSEIGDASKVKVSGKGLIEGHTFEVAEFIVDTRSAGYGGLGLSIEGPSKVDINCSDVDDGTCKVTYCPTEPGTYIINIKFADQHVPGSPFTVKVLGEGRMKESITRKRQAPSIATVGSTCDLNLKIPGNWFQMVSAQERLTRTFTRSSHTYTRTERTEISKTRAGETKREVRVEESTQVGGDPFRDVFGGFMGRESLGPFNSPQGRQSEGESGTQEMTAQVTSPSGNTEDAEIIEGEDSTYSVRFVPHEMGPHTVNVKYRGQHVPGSPFQFTVGPLGEGGAHKVRAGGTGLDRGVAGVPAEFSIWTREAGAGGLSIAVEGPSKAEISFEDRKDGSCGVAYIVQEPGDYEVSIKFNDEHIPDSPFIVPIASLSDDARLLTVTSLQEMGLKVNQEASFAVQLNGARGAIDAKVHTPSGAVEECYITELDNDKHAIRFIPRENGVHSIDVRFNGSHIPGSPFKIRVGEPGQAGDPGMVTAFGPGLEGGTTGVPSDFIVNTCNAGSGALSVTIDGPSKVKMDCQECPEGYKVTYTPMAPGSYLISIKYGGPQHIVGSPFKAKVSGARLSGGHSLHETSSVLVETVTKSSSVAGSFSTLPKFSSDASKVVSRGAGLSKAFIGQKNTFTVDCSKAGTNMLMVGVHGPKTPCEEVYVKHMGNRMYNVTYTVKEKGDYILIVKWGEEMVPGSPFHVTVP

SEQ ID NO: 424 - protein, 398 aa, Homo sapiens; identical to SEQ ID NO: 265

SEQ ID NO: 425 - protein, 410 aa, Mus musculus
MFILLVLVTGVSAFTTPTVVHTGKVSESPITSEKPTVHGDNCQFRGREFKSELRLEGEPVVLRCPLAPHSDISSSSHSFLTWSKLDSSQLIPRDEPRMWVKGNILWILPAVQQDSGTYICTFRNASHCEQMSVELKVFKNTEASLPHVSYLQISALSTTGLLVCPDLKEFISSNADGKIQWYKGAILLDKGNKEFLSAGDPTRLLISNTSMDDAGYYRCVMTFTYNGQEYNITRNIELRVKGTTTEPIPVIISPLETIPASLGSRLIVPCKVFLGTGTSSNTIVWWLANSTFISAAYPRGRVTEGLHHQYSENDENYVEVSLIFDPVTREDLHTDFKCVASNPRSSQSLHTTVKEVSSTFSWSIALAPLSLIILVVGAIWMRRRCKRRAGKTYGLTKLRTDNQDFPSSPN

SEQ ID NO: 426 - protein, 393 aa, Chlorocebus aethiops
MFRLYVLVMGVSAFTLQPAAHTGAARSCPVRGRHYKREFRLEGEPVALRCPQVPYQLWASVSPHINLTWHKNDSARMVPGEEETRMWAQDGALWLLPALQEDSGTYICTTRNASYCDKVSIELRVFENTDASLPFISYPQILTLSTFGVLVCPDLREFTRDKTDGKIQWYKDFLPLDKDNEKFLSVRGTTHLLVHDVALEDAGYYRCVLTFAHEGQQYNITRNIELRIKKKKEETIPVIISPLKTISASLGSRLTIPCKVFLGTGTPLTTMLWWTANDTHVESAYPGGRVTEGPRQEYSENNENYIEVPLIFDPVTRKDLNMVFKCFVRNTMGFQTLRTTVKEPPPTFSWGIVLAPLALAFLVLGGIWMHRRCKHRTGKADGLTVLRPHHQDF

SEQ ID NO: 427 - protein, 416 aa, Rattus norvegicus
MFILLVLVTGVSAFTTPAVVHTGRVSESPVTSEKHPVLGDDCWFRGRDFKSELRLEGEPVVLRCPLVPHSDTSSSSRSLLTWSKSDSSQLIPGDEPRMWVKDDTLWVLPAVQQDSGTYICTFRNASHCEQMSLELKVFKNTEASFPLVSYLQISALSSTGLLVCPDLKEFISSRTDGKIQWYKGSILLDKGNKKFLSAGDPTRLLISNTSMGDAGYYRCVMTFTYEGKEYNITRNIELRVKGITTEPIPVIISPLETIPASLGSRLIVPCKVFLGTGTSSNTIVWWMANSTFISVAYPRGRVTEGLHHQYSENDENYVEVSLIFDPVTKEDLNTDFKCVATNPRSFQSLHTTVKEVSSTFSWGIALAPLSLIILVVGAIWIRRRCKRQAGKTYGLTKLPTDNQDFPSSPNQIKEMK

SEQ ID NO: 428 - protein, 410 aa, Mus musculus; identical to SEQ ID NO: 425

SEQ ID NO: 429 - protein, 280 aa, Mus musculus
MSVELKVFKNTEASLPHVSYLQISALSTTGLLVCPDLKEFISSNADGKIQWYKGAILLDKGNKEFLSAGDPTRLLISNTSMDDAGYYRCVMTFTYNGQEYNITRNIELRVKGTTTEPIPVIISPLETIPASLGSRLIVPCKVFLGTGTSSNTIVWWLANSTFISAAYPRGRVTEGLHPQYSENDENYVEVSLIFDPVTREDLHTDFKCVASNPRSSQSLHTTVKEVSSTFSWSIALAPLSLIILVVGAIWMRRRCKRRAGKTYGLTKLRTDNQDFPSSPN

SEQ ID NO: 430 - protein, 253 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 431 - protein, 254 aa, Mus musculus; identical to SEQ ID NO: 267

SEQ ID NO: 432 - protein, 254 aa, Mesocricetus auratus
MANLSYWLLALFVAMWTDVGLCKKRPKPGGWNTGGSRYPGQGSPGGNRYPPQGGGTWGQPHGGGWGQPHGGGWGQPHGGGWGQPHGGGWGQGGGTHNQWNKPSKPKTNMKHMAGAAAAGAVVGGLGGYMLGSAMSRPMMHFGNDWEDRYYRENMNRYPNQVYYRPVDQYNNQNNFVHDCVNITIKQHTVTTTTKGENFTETDIKIMERVVEQMCTTQYQKESQAYYDGRRSSAVLFSSPPVILLISFLIFLMVG

SEQ ID NO: 433 - protein, 254 aa, Rattus norvegicus
MANLGYWLLALFVTTCTDVGLCKKRPKPGGWNTGGSRYPGQGSPGGNRYPPQSGGTWGQPHGGGWGQPHGGGWGQPHGGGWGQPHGGGWSQGGGTHNQWNKPSKPKTNLKHVAGAAAAGAVVGGLGGYMLGSAMSRPMLHFGNDWEDRYYRENMYRYPNQVYYRPVDQYSNQNNFVHDCVNITIKQHTVTTTTKGENFTETDVKMMERVVEQMCVTQYQKESQAYYDGRRSSAVLFSSPPVILLISFLIFLIVG

SEQ ID NO: 434 - protein, 256 aa, Ovis aries
MVKSHIGSWILVLFVAMWSDVGLCKKRPKPGGGWNTGGSRYPGQGSPGGNRYPPQGGGGWGQPHGGGWGQPHGGGWGQPHGGGWGQPHGGGGWGQGGSHSQWNKPSKPKTNMKHVAGAAAAGAVVGGLGGYMLGSAMSRPLIHFGNDYEDRYYRENMYRYPNQVYYRPVDRYSNQNNFVHDCVNITVKQHTVTTTTKGENFTETDIKIMERVVEQMCITQYQRESQAYYQRGASVILFSSPPVILLISFLIFLIVG

SEQ ID NO: 435 - protein, 264 aa, Bos taurus
MVKSHIGSWILVLFVAMWSDVGLCKKRPKPGGGWNTGGSRYPGQGSPGGNRYPPQGGGGWGQPHGGGWGQPHGGGWGQPHGGGWGQPHGGGWGQPHGGGGWGQGGTHGQWNKPSKPKTNMKHVAGAAAAGAVVGGLGGYMLGSAMSRPLIHFGSDYEDRYYRENMHRYPNQVYYRPVDQYSNQNNFVHDCVNITVKEHTVTTTTKGENFTETDIKMMERVVEQMCITQYQRESQAYYQRGASVILFSSPPVILLISFLIFLIVG

SEQ ID NO: 436 - protein, 252 aa, Oryctolagus cuniculus
MAHLGYWMLLLFVATWSDVGLCKKRPKPGGGWNTGGSRYPGQSSPGGNRYPPQGGGWGQPHGGGWGQPHGGGWGQPHGGGWGQPHGGGWGQGGTHNQWGKPSKPKTSMKHVAGAAAAGAVVGGLGGYMLGSAMSRPLIHFGNDYEDRYYRENMYRYPNQVYYRPVDQYSNQNSFVHDCVNITVKQHTVTTTTKGENFTETDIKIMERVVEQMCITQYQQESQAAYQRAAGVLLFSSPPVILLISFLIFLIVG

SEQ ID NO: 437 - protein, 257 aa, Sus scrofa
MVKSHIGGWILVLFVAAWSDIGLCKKRPKPGGGWNTGGSRYPGQGSPGGNRYPPQGGGGWGQPHGGGWGQPHGGGWGQPHGGGWGQPHGGGGWGQGGGSHGQWNKPSKPKTNMKHVAGAAAAGAVVGGLGGYMLGSAMSRPLIHFGSDYEDRYYRENMYRYPNQVYYRPVDQYSNQNSFVHDCVNITVKQHTVTTTTKGENFTETDVKMIERVVEQMCITQYQKEYEAYAQRGASVILFSSPPVILLISFLLFLIVG

SEQ ID NO: 438 - protein, 253 aa, Macaca mulatta
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHNQWHKPSKPKTSMKHMAGAAAAGAVVGGLGGYMLGSAMSRPLIHFGNDYEDRYYRENMYRYPNQVYYRPVDQYSNQNNFVHDCVNITIKQHTVTTTTKGENFTETDVKMMERVVEQMCITQYEKESQAYYQRGSSMVLFSSPPVILLISFLIFLIVG

SEQ ID NO: 439 - protein, 253 aa, Pan troglodytes
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDQYSSQNNFVHDCVNITIKQHTVTTTTKGENFTETDVKMMERVVEQMCITQYERESQAYYQRGSSMVLFSSPPVILLISFLIFLIVG

SEQ ID NO: 440 - protein, 253 aa, Gorilla gorilla gorilla
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDQYSNQNNFVHDCVNITIKQHTVTTTTKGENFTETDVKMMERVVEQMCITQYERESQAYYQRGSSMVLFSSPPVILLISFLIFLIVG

SEQ ID NO: 441 - protein, 254 aa, Cricetulus griseus
MANLSYWLLALFVATWTDVGLCKKRPKPGGWNTGGSRYPGQGSPGGNRYPPQGGGTWGQPHGGGWGQPHGGGWGQPHGGGWGQPHGGGWGQGGGTHNQWNKPSKPKTNMKHVAGAAAAGAVVGGLGGYMLGSAMSRPMLHFGNDWEDRYYRENMNRYPNQVYYRPVDQYNNQNNFVHDCVNITIKQHTVTTTTKGENFTETDVKMMERVVEQMCVTQYQKESQAYYDGRRSSAVLFSSPPVILLISFLIFLIVG

SEQ ID NO: 442 - protein, 256 aa, Capra hircus
MVKSHIGSWILVLFVAMWSDVGLCKKRPKPGGGWNTGGSRYPGQGSPGGNRYPPQGGGGWGQPHGGGWGQPHGGGWGQPHGGGWGQPHGGGGWGQGGSHSQWNKPSKPKTNMKHVAGAAAAGAVVGGLGGYMLGSAMSRPLIHFGNDYEDRYYRENMYRYPNQVYYRPVDQYSNQNNFVHDCVNITVKQHTVTTTTKGENFTETDIKIMERVVEQMCITQYQRESQAYYQRGASVILFSPPPVILLISFLIFLIVG

SEQ ID NO: 443 - protein, 256 aa, Felis catus
MVKSHIGSWILVLFVAMWSDVGLCKKRPKPGGGWNTGGSRYPGQGSPGGNRYPPQGGGGWGQPHGGGWGQPHGGGWGQPHGGGWGQPHGGGGWGQGGSHSQWNKPSKPKTNMKHMAGAAAAGAVVGGLGGYMLGSAMSRPLIHFGNDYEDRYYRENMYRYPNQVYYRPVDQYSNQNNFVHDCVNITVKQHTVTTTTKGENFTETDMKIMERVVEQMCVTQYQKESEAYYQRRASAILFSSPPVILLISFLIFLIVG

SEQ ID NO: 444 - protein, 255 aa, Canis lupus familiaris
MVKSHIGSWILVLFVAMWSDVGLCKKRPKPGGGWNTGGSRYPGQGSPGGNRYPPQGGGGWGQPHGGGWGQPHGGGWGQPHGGGWGQPHGGGGWGQGGTHSQWNKPSKPKTNMKHVAGAAAAGAVVGGLGGYLLGSAMSRPLIHFGNDCEDRYYRENMYRYPNQVYYRSVDQYNNQSTFVHDCVNITVKQHTVTTTKGENFTETDIKMMERVVEQMCITQYQRESEAYYQRGASVILFSSPPVILLVSFLIFLIVG

SEQ ID NO: 445 - protein, 224 aa, Xenopus tropicalis
MMLRSLWTSLVLISLVCALTVSSKKSGSGKSKTGGWNSGSNRNPNYPGGYGWNTGGNTGGSWGQPYNPSGGNNFNNKQWKPPKSKTNMKAVAVGAAAGAIGGYMLGNAMGRMSYHFSNPMEARYYNDYYNQMPERVYRPMYRGEEHVSEDRFVTDCYNMSVTEYIIKPAEGKNTSEVNQLETRVKSQIIREMCITEYRRGSGFKVLSNPWLILTITLFVYFVIE

SEQ ID NO: 446 - protein, 274 aa, Taeniopygia guttata
MAKLPGTSCLLLLLLLLLGADLASCKKGKGKPGGGGWGTGSRQPSYPRQPGYPQNPGYPHNPGYPHNPGYPHNPGYPHNPGYPHNPGYPHNPGYPGWNQGYNPSSGGNYHQKPWKAPKPKTNLKHVAGAAAAGAVVGGLGGYAMGRVMSGMQYRFDSPDEYRWWSENAARYPNQVYYRDYRGGAVPQDVFVADCFNITVTEHNIGPAAKKNASEAGAALNQTEAELETRVVTKVIREMCIQQYQEYRLAAGTRPRLAADAALAALLLLALAALR

SEQ ID NO: 447 - protein, 179 aa, Gasterosteus aculeatus
MSALQKVPLTAALCLLLLVTLLPSSEARRGRGGFGGGGGFGRGGGFGRGGGGGFGRGGGGGYGRIQSSGPSAGKVAGAAAAGAIGGAMIGSALSRPGYGGGYGGGYGGGYGGGYGGYGGGYGYPRHGGGGYGPRPGYDPEGSGDMEYYTGASSGPIYNSIVVVIGALMSLLVARWGALE

SEQ ID NO: 448 - protein, 399 aa, Gasterosteus aculeatus
MKPGSLSELCLLLLLCHTHLSLAKRGGGGFGKGIGSKKSSWSSRGSTSGNAGNRNNAGSSSQGGYPKQPAQPNQGGYPPQSGRPGNPGGYPQQPGGGYPNQYPARGSPYGGGGYGGHGGYGAHGGYGGYGGGYINQNPNNRVLSPQYGGSFGYGGHAGRGGSPFSHSVQSMGMRPSDRSRGFGRSAVMAAGGGALVGMALGYGLGRFPRPPFSFHNPQEEHYYNHYMYRRYGAKSTDANDYSRDYRYSQVPQTYDSYMDSCMKRADLLPAGNPKPVDTNNNPAATTTTANASVVASAPNNSLTPGPVTPRPPNWPPDSQVAAVADVEDDDTVSIEEIGYPALIEQVKARRCLELYVVYAERYLVRPTDGAQRPEALGFVAVVTSATLMLLNSNMLMLLR

SEQ ID NO: 449 - protein, 640 aa, Homo sapiens
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 450 - protein, 700 aa, Mus musculus
MEIYPPDMSEGAGGRSSSPSTQLSADPSLDGLPAAEHMPDTHTEDGRSPGLLGLAVPCCVCLEAERLRGCLNSEKICIVPILACLVSLCLCIAGLKWVFVDKIFEYDSPTHLDPGGLGQDPVISLDPTAASAVLVSSEAYTSPVSKAQSEAEAHVTGQGDHVAVASEPSAVPTRKNRLSAFPPLHSTPPPFPSPARTPEVRTPKSGTQPQTTETNLQTAPKLSTSTSTTGTSHLIKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRQKLHDRLRQSLRSERNNMVNIANGPHHPNPPPENVQLVNQYVSKNVISSEHIVEREVETSFSTSHYTSTAHHSTTVTQTPSHSWSNGHTESIISESHSVIMMSSVENSRHSSPAGGPRGRLHGLGGPRECNSFLRHARETPDSYRDSPHSERYVSAMTTPARMSPVDFHTPSSPKSPPSEMSPPVSSMTVSMPSVAVSPFVEEERPLLLVTPPRLREKKYDHHPQQLNSFHHNPAHQSTSLPPSPLRIVEDEEYETTQEYEPIQEPIKKVTNSRRAKRTKPNGHIANRLEMDSNPSSVSSNSESETEDERVGEDTPFLGIQNPLAASLEVAPAFRLAESRTNPAGRFSTQEELQARLSSVIANQDPIAV

SEQ ID NO: 451 - protein, 645 aa, Mus musculus
MSERKEGRGKGKGKKKDRGSRGKPAPAEGDPSPALPPRLKEMKSQESAAGSKLVLRCETSSEYSSLRFKWFKNGNELNRRNKPQNVKIQKKPGKSELRINKASLADSGEYMCKVISKLGNDSASANITIVESNDLTTGMSASTERPYVSSESPIRISVSTEGANTSSSTSTSTTGTSHLIKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRQKLHDRLRQSLRSERNNMVNIANGPHHPNPPPENVQLVNQYVSKNVISSEHIVEREVETSFSTSHYTSTAHHSTTVTQTPSHSWSNGHTESIISESHSVIMMSSVENSRHSSPAGGPRGRLHGLGGPRECNSFLRHARETPDSYRDSPHSERYVSAMTTPARMSPVDFHTPSSPKSPPSEMSPPVSSMTVSMPSVAVSPFVEEERPLLLVTPPRLREKKYDHHPQQLNSFHHNPAHQSTSLPPSPLRIVEDEEYETTQEYEPIQEPIKKVTNSRRAKRTKPNGHIANRLEMDSNPSSVSSNSESETEDERVGEDTPFLGIQNPLAASLEVAPAFRLAESRTNPAGRFSTQEELQARLSSVIANQDPIAV

SEQ ID NO: 452 - protein, 462 aa, Mus musculus
MSERKEGRGKGKGKKKDRGSRGKPAPAEGDPSPALPPRLKEMKSQESAAGSKLVLRCETSSEYSSLRFKWFKNGNELNRRNKPQNVKIQKKPGKSELRINKASLADSGEYMCKVISKLGNDSASANITIVESNDLTTGMSASTERPYVSSESPIRISVSTEGANTSSSTSTSTTGTSHLIKCAEKEKTFCVNGGECFMVKDLSNPSRYLCKCQPGFTGARCTENVPMKVQTQEKAEELYQKRVLTITGICIALLVVGIMCVVAYCKTKKQRQKLHDRLRQSLRSERNNMVNIANGPHHPNPPPENVQLVNQYVSKNVISSEHIVEREVETSFSTSHYTSTAHHSTTVTQTPSHSWSNGHTESIISESHSVIMMSSVENSRHSSPAGGPRGRLHGLGGPRECNSFLRHARETPDSYRDSPHSERHNLIAELRRNKAYRSKCMQIELSATHLRSSSIPHLGFIL

SEQ ID NO: 453 - protein, 640 aa, Mus musculus
MSERKEGRGKGKGKKKDRGSRGKPAPAEGDPSPALPPRLKEMKSQESAAGSKLVLRCETSSEYSSLRFKWFKNGNELNRRNKPQNVKIQKKPGKSELRINKASLADSGEYMCKVISKLGNDSASANITIVESNDLTTGMSASTERPYVSSESPIRISVSTEGANTSSSTSTSTTGTSHLIKCAEKEKTFCVNGGECFMVKDLSNPSRYLCKCQPGFTGARCTENVPMKVQTQEKAEELYQKRVLTITGICIALLVVGIMCVVAYCKTKKQRQKLHDRLRQSLRSERNNMVNIANGPHHPNPPPENVQLVNQYVSKNVISSEHIVEREVETSFSTSHYTSTAHHSTTVTQTPSHSWSNGHTESIISESHSVIMMSSVENSRHSSPAGGPRGRLHGLGGPRECNSFLRHARETPDSYRDSPHSERYVSAMTTPARMSPVDFHTPSSPKSPPSEMSPPVSSMTVSMPSVAVSPFVEEERPLLLVTPPRLREKKYDHHPQQLNSFHHNPAHQSTSLPPSPLRIVEDEEYETTQEYEPIQEPIKKVTNSRRAKRTKPNGHIANRLEMDSNPSSVSSNSESETEDERVGEDTPFLGIQNPLAASLEVAPAFRLAESRTNPAGRFSTQEELQARLSSVIANQDPIAV

SEQ ID NO: 454 - protein, 662 aa, Rattus norvegicus
MSERKEGRGKGKGKKKDRGSRGKPGPAEGDPSPALPPRLKEMKSQESAAGSKLVLRCETSSEYSSLRFKWFKNGNELNRKNKPENIKIQKKPGKSELRINKASLADSGEYMCKVISKLGNDSASANITIVESNEFITGMPASTETAYVSSESPIRISVSTEGANTSSSTSTSTTGTSHLIKCAEKEKTFCVNGGECFTVKDLSNPSRYLCKCPNEFTGDRCQNYVMASFYMTSRRKRQETEKPLERKLDHSLVKESKAEELYQKRVLTITGICIALLVVGIMCVVAYCKTKKQRQKLHDRLRQSLRSERSNLVNIANGPHHPNPPPENVQLVNQYVSKNVISSEHIVEREVETSFSTSHYTSTAHHSTTVTQTPSHSWSNGHTESVISESNSVIMMSSVENSRHSSPAGGPRGRLHGLGGPRDNSFLRHARETPDSYRDSPHSERYVSAMTTPARMSPVDFHTPSSPKSPPSEMSPPVSSMTVSMPSVAVSPFVEEERPLLLVTPPRLREKKYDHHPQQLNSFHHNPAHQSTSLPPSPLRIVEDEEYETTQEYESVQEPVKKVTNSRRAKRTKPNGHIANRLEMDSNTSSVSSNSESETEDERVGEDTPFLGIQNPLAASLEVAPAFRLAESRTNPAGRFSTQEELQARLSSVIANQDPIAV

SEQ ID NO: 455 - protein, 638 aa, Canis lupus familiaris
MSERKEGRGKGKGKKERGSGKKPAPPEGGQSPALPPRLKEMRSQESAAGSKLVLRCETSSEYSSLKFKWFKNGNELNRKNKPQNIKIQKKPGKSELRISKASLADSGEYMCKVTSKLGNDSASANITIVDSNDIITGMPASTERAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMVNIANGPHHPNPPPENVQLVNQYVSKNVISSEHIVEREAETSFSTSHYTSTAHHSTTVTQTPSHSWSNGHTESIISESHSVIMMSSVENSRHSSPSGGPRGRLNGLGGPRECNSFLRHARETPDSYRDSPHSERYVSAMTTPARMSPVDFHTPSSPKSPPSETSPPVSSTTVSMPSMAVSPFVEEERPLLLVTPPRLREKYDHHSQQFNSYHHNPAHESNSLPPSPLRIVEDEEYETTQEYEPAQEPVKKLTSSRRAKRTKPNGHIANRLEMDSNASAEGTNSESETEDERVGEDTPFLGIQNPLAASLEAAPAFRLADSRTNPAGRFSTQEELQARLSSVIANQDPIAV

SEQ ID NO: 456 - protein, 701 aa, Bos taurus
MEIYSPDMSEGAAERSSSPSTQLSADPSLDGLPAAEDMPETQTEDGRSPGLVGLTLPCCVCLETERLRGCLNSEKICIVPILACLVSLCLCIAGLKWVFVDKIFEYDSPTHLDPGGLGQDPIISLDPTAASAAVWVSAKAYTSPVSRAQSETEVRVTVQVDNALGSSEPSAVPTPKNRIFAFSFRPSTAPSLPSPTRSPDVRTPKAATQPPSTETNLQTAPKLSTSTSTAGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNTMMNVANGPHHPNPPPENVQLVNQYVSKNVISSEHIVEREAETSFSTSHYTSTAHHSTTVTQTPSHSWSNGHTESIISESHSVIVMSSVENSRHSSPTGGPRGRLNGLGGPRECNSFLRHARETPDSYRDSPHSERYVSAMTTPARMSPVDFHTPSSPKSPPSEMSPPVSSTTVSMPSMAVSPFVEEERPLLLVTPPRLREKYDHHAQQFNSFHCNPAHESNSLPPSPLRIVEDEEYETTQEYEPAQEPVKKLTNSSRRAKRTKPNGHIAHRLEMDNNTGADSSNSESETEDERVGEDTPFLAIQNPLAASLEAAPAFRLVDSRTNPTGRFSPQEELQARLSGVIANQDPIAV

SEQ ID NO: 457 - protein, 645 aa, Pan troglodytes
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMVVSPFVEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 458 - protein, 606 aa, Ornithorhynchus anatinus
MSDRKESQPKGRGKKKERGSGKNPAPEKGQAAESRGPAVPPRLKEMKNQESVAGAKLVLRCETSSEYSFLKFKWFKNGSELNKKNKPQNIKIQKKPGKSELRISKASLADSGEYMCKVISKLGNDSTFANITIVESNATSTSTTGTSHLVKCAEKEKTFCVNGGECFMVKDLSNPSRYLCRCPNEFTGDRCQNYVMASFYKAEELYQKRVLTITGICIALLVVGIMCVVAYCKTKKQRKKLHDRLRQSLRSERNNMVNLANGPHHPNPPPENVQLVNQYVSKNVISSEHVIERETETSFSTSHYTSTTHHSTTVTQTPSHSWSNGHTESIISESHSVLMTSSVENSRHTSPTGGPRGRLNGIGGPRECNSFLRHARETPDSYRDSPHSERYVSAMTTPARMSPVDFHTPSSPKSPPSEMSPPMSSLTVSVPSVAVSPFIEEERPLLLVTPPRLREKYDHHPQQFNSFHHNAAHESNSLPASPLRIVEDEEYETTQEYEPAQEPAKKLVNSRRAKRTKPNGLISNRVEMDSDTGSESSSSESETEDERIGEDTPFLSLQNPMATSLEPGPAFRLAENRTNPPSRFSTQEELQARLSSVIANQDPIAV

SEQ ID NO: 459 - protein, 643 aa, Equus caballus
MSERKEGRGKGKGKKERGSGRKPAPAEGGPSPALPPRLKEMKSQESVAGSKLVLRCETSSEYSSLRFKWFKNGNELNRKNKPQNIKIQKKPGKSELRINKASVTDSGEYMCKVISKLGNDSASANITIVDSNEIFTGMPASTETAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMVNIANGPHHPNPPPENVQLVNQYVSKNVISSEHIVEREVETSFSTSHYTSTAHHSTTVTQTPSHSWSNGHTESIISESHSVIMMSSVENSRHSSPTGGPRGRLNGMGGPRECNSFLRHARETPDSYRDSPHSERYVSAMTTPARMSPVDFHTPSSPKSPPSEMSPPVSSTTVSMPSMAVSPFVEEERPLLLVTPPRLREKYDHHPQQFNSFHHNPAHESNSLPPSPLRIVEDEEYETTQEYEPAQEPVKKLTNSRRAKRTKPNGHIANRLEMDSNTSAESSNSESETEDERVGEDTPFLGIQNPLAASVEAAPAFRLADSRTNPAGRFSTQEELQARLSSVIANQDPIAV

SEQ ID NO: 460 - protein, 700 aa, Cavia porcellus
MEIYSPDMSEGAAERSSSPSTQLSADPSLNGLPAAEDMPEPQTEDGSPAGLMGLAVPCCVYLEAERLRGCLNSEKICIVPILACLVSLCLCIAGLKWVFVDKIFEYDSPTHLDPGGLGQDPIISLDPTAASAVWVSSEAYTSPISRAQSETKVQVTVQGDNAAASSEPTAAPTPKNRIFAFSLLPSTAPFFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYKHLGIEFMEAEELYQKRVLTISGICIALLVVGIMCVVAYCKTKKQRKKLHDRLRQSLRSERNNMVNIANGPHHPNPPPENVQLVNQYVSKNVISSEHIVEREAETSFSTSHYTSTTHHSTTVTQTPSHSWSNGHTESILSESHSVIVMSSVENSRHSSPSGGPRGRLNGLGGPRECNSFLRHARETPDSYRDSPHSERYVSAMTTPARMSPVDFHTPSSPKSPPSEMSPPASSMTVSMPSMAVSPFVEEERPLLLVTPPKLRDKKYDHHPQQFSNFHHNPAHESNSLPPSPLRIVEDEEYETTQEYEPAQEPVKKLANSRRAKRTKPNGHIANRLELDSNTSSENSNSESETEDERVGEDTPFLGVQNPLAAGLEAAPAFRLSDSRTNPAGRFSTQEELQARLSSVIANQDPIAV

SEQ ID NO: 461 - protein, 685 aa, Gallus gallus
MSEVGTETFPSPSAQLSPDASLGGLPAEENMPGPHREDSRVPGVAGLASTCCVCLEAERLKGCLNSEKICIAPILACLLSLCLCIAGLKWVFVDKIFEYDSPTHLDPGRIGQDPRSTVDPTALSAWVPSEVYASPFPIPSLESKAEVTVQTDSSLMPSRPFLQPSLYNRILDVGLWSSATPSLSPSSLEPTTASQAQATETNLQTAPKLSTSTSTTGTSHLTKCDIKQKAFCVNGGECYMVKDLPNPPRYLCRCPNEFTGDRCQNYVMASFYKHLGIEFMEAEELYQKRVLTITGICIALLVVGIMCVVAYCKTKKQRKKLHDRLRQSLRSERNNVMNMANGPHHPNPPPDNVQLVNQYVSKNIISSERVVERETETSFSTSHYTSTTHHSMTVTQTPSHSWSNGHTESILSESHSVLVSSSVENSRHTSPTGPRGRLNGIGGPREGNSFLRHARETPDSYRDSPHSERYVSAMTTPARMSPVDFHTPTSPKSPPSEMSPPVSSLTISIPSVAVSPFMDEERPLLLVTPPRLREKYDNHLQQFNSFHNNPTHESNSLPPSPLRIVEDEEYETTQEYEPAQEPPKKLTNSRRVKRTKPNGHISSRVEVDSDTSSQSTSSESETEDERIGEDTPFLSIQNPMATSLEPAAAYRLAENRTNPANRFSTPEELQARLSSVIANQDPIAV

SEQ ID NO: 462 - protein, 700 aa, Rattus norvegicus
MEIYSPDMSEVAGGRSSSPSTQLSAAPSLDGLPAAEEHIPDTHTEDERSPGLLGLAVPCCVCLEAERLRGCLNSEKICIVPILACLVSLCLCIAGLKWVFVDKIFEYDSPTHLDPGGLGQDPVISLDPTAAPAILVSSEAYTSPVSKAQSEAGAHVTVQGDHAAVASEPSAVPTRKNRLSAFPPFHSTAPPFPSPARTPEVRTPKSGTQPQTTETNLQTAPKLSTSTSTTGTSHLIKCAEKEKTFCVNGGECFTVKDLSNPSRYLCKCPNEFTGDRCQNYVMASFYKHLGIEFMEAEELYQKRVLTITGICIALLVVGIMCVVAYCKTKKQRQKLHDRLRQSLRSERSNLVNIANGPHHPNPPPENVQLVNQYVSKNVISSEHIVEREVETSFSTSHYTSTAHHSTTVTQTPSHSWSNGHTESIISESNSVIMMSSVENSRHSSPAGGPRGRLHGLGGPRDNSFLRHARETPDSYRDSPHSERYVSAMTTPARMSPVDFHTPSSPKSPPSEMSPPVSSMTVSMPSVAVSPFVEEERPLLLVTPPRLREKKYDHHPQQLNSFHHNPAHQSTSLPPSPLRIVEDEEYETTQEYESVQEPVKKVTNSRRAKRTKPNGHIANRLEMDSNTSSVSSNSESETEDERVGEDTPFLGIQNPLAASLEVAPAFRLAESRTNPAGRFSTQEELQARLSSVIANQDPIAV

SEQ ID NO: 463 - protein, 533 aa, Pelodiscus sinensis
MYSELHIYRASLADAGEYTCKVSSKLGNDSTKASITITDTNEPVFRIQASTEGTNASSSTSTSTTGTSHLTKCDIKQKAFCVNGGECYMVKDLPNPPRYLCRCPNEFTGDRCQNYVMASFYKHLGIEFMEAEELYQKRVLTITGICIALLVVGIMCVVAYCKTKKQRKKLHDRLRQSLRSERHNMVNVANGPHHPNPPPENVQLVNHVSKNVIASEHVIERETETSFSTSRYTSTTHHSTTVTQTPSHSWSNGRTESILSESHSVLMSSSVENSRHTSPAGPRGRLSGIGGPREYNSFLRHARETPDSYRDSPHSERYVSAMTTPARMSPVDFHTPSSPKSPPSEMSPPVSSLTVSVPSVAVSPFMEEERPLLLVTPPRLREKYDSHLQQFNSFHHNPAHESNSPPPSPLRIVEDEEYETTQEYEPAQEPPKKLVNSRRAKRTKPNGHISNRLEADTDTSSESSSSESETEDERIGEDTPFLSIQNPVATSLEPAPAYRLADSRTNPTSRFSTQEELQARLSSVIANQDPIAV

SEQ ID NO: 464 - protein, 713 aa, Macaca mulatta
VPSAGEPGEEAPYLVKVHQVWAVKAGGLKKDSLLTVRLGTWGHPAFPSCGRLKEDSRYIFFMEPDANSTSRVPAAFRASFPPLETGRNLKKEVSRVLCKRCALPPRLKEMKSQESAAGSKLVLRCETSSEYSSLRFKWFKNGNELNRKNKPQNIKIQKKPGKSELRISKASLADSGEYMCKVISKLGNDSASANITIVDSNEIITGMPASTEGAYMSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIMMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFVEEERPLLLVTPPRLREKKFDHHPQQFSSFHHNPAHDSNSLPPSPLRIVEDEEYETTQEYEPAQEPVKKLANSRRAKRTKPNGHIANRLEVDGNTSSQSSNSESETEDERVGEDTPFLGIQNPLAASLEATPAFRLADSRTNPAGRFSTQEEIQARLSSVIANQDPIAV

SEQ ID NO: 465 - protein, 602 aa, Gallus gallus
MWATSEGPLQYSLAPTQTDVNSSYNTVPPKLKEMKNQEVAVGQKLVLRCETTSEYPALRFKWLKNGKEITKKNRPENVKIPKKQKKYSELHIYRATLADAGEYACRVSSKLGNDSTKASVIITDTNATSTSTTGTSHLTKCDIKQKAFCVNGGECYMVKDLPNPPRYLCRCPNEFTGDRCQNYVMASFYKHLGIEFMEAEELYQKRVLTITGICIALLVVGIMCVVAYCKTKKQRKKLHDRLRQSLRSERNNVMNMANGPHHPNPPPDNVQLVNQYVSKNIISSERVVERETETSFSTSHYTSTTHHSMTVTQTPSHSWSNGHTESILSESHSVLVSSSVENSRHTSPTGPRGRLNGIGGPREGNSFLRHARETPDSYRDSPHSERYVSAMTTPARMSPVDFHTPTSPKSPPSEMSPPVSSLTISIPSVAVSPFMDEERPLLLVTPPRLREKYDNHLQQFNSFHNNPTHESNSLPPSPLRIVEDEEYETTQEYEPAQEPPKKLTNSRRVKRTKPNGHISSRVEVDSDTSSQSTSSESETEDERIGEDTPFLSIQNPMATSLEPAAAYRLAENRTNPANRFSTPEELQARLSSVIANQDPIAV

SEQ ID NO: 466 - protein, 677 aa, Xenopus laevis
MAEKKKVKEGKGRKGKGKKDRKGKKAEGSDQGAAASPKLKEIKTQSVQEGKKLVLKCQAVSEQPSLKFRWFKGEKEIGAKNKPDSKPEHIKIRGKKKSSELQISKASSADNGEYKCMVSNQLGNDTVTVNVTIVPKPTYNHLLLMKIYLKVTSVEKSVEPSTLNLLESQKEVIFATTKRGDTTAGPGHLIKCSDKEKTYCVNGGECYVLNGITSSNQFMCKCKPGFTGARCTETDPLRVVRSEKHLGIEFMEAEELYQKRVLTITGICIDLLVVGDMCVVDAYCKTKKQRKKLNDRLRQSLRERNKNITNKDNRPHNPKNPPPRKNVQLVNQYVSKNVISSEHVIERETETSFSTSHYTSTTHHSTTVTQTPSHSWSNGLSESMISEKSYSVIVTSSVENSRHTSPTGPRGRLNGIGGPRDCSYLRHARDTPDSYRDSPHSERYVSAMTTPARMSPVEFKTPISPKSPCLETSPPESSLAVSVPSVAVSPFIEEERPLLLVSPPRLREKRYDRKTPQKTPHKQHNSYHHNPGHDSSSLPPNPLRIVEDEEYETTQEYEPSLEPAKKLVNSRRQKRTKPNGHISNRLELDSDSSSESSTSESETEDERIGEETPFLSIQNPLAASLESASLYRHADSRTNPTSRFSTQEELQARLSSIANQALCDQKKRKMTCKTLFI

SEQ ID NO: 467 - protein, 599 aa, Danio rerio
MAEVKAGKEGKSGDKKKDKESVRSNKPDNSPQAEPKLKNLRSVTVEDGKKTVLKCEILAGNPAPNVKWYKNGKELTGKNKPKSIKIKKKKQGKISELLIRKSTEGDAGLYTCEAVNSLGKTNTTANLFIINTATSTTPSAKTSSHVTPCNESEKEYCVNHGKCFTLEVTPGNIRRLCRCPPGFTGNRCQNRDPVRVVDHKQAEELYQKRVLTITGICIALLVVGIMCVVAYCKTKKQRKKLHDRLRQSLRERNAAAKGPQHPHPPPENLQLVNHYMPTNPVPAHMTDKEAETSLSTNEFTSPTHPSTAITHSSSQCWSNGKAESVVSDSHAVLMKPSAENCQHGTPSHRGRLNATGGVHQLNDYLKNSREAQGSNRDSPYSERYVSAMTTPTRLSPVGLLSPVTPSSPPSEMSAPLSSLATSVPSMLTSPSGEEERPLLFRTPPILRDKSASTQGRKSGHNLRNSAHYNHGLDIPSPPPSPLHIEEEIDCLEQYKSTSVPSSAPHSPSAARTQPSGQAAPEQAVSGSNSESSSSESETEDERVGEDTPFLGLQNPLAAGSLVLDGLEGSRTNPALHLSPQHELQNRLTAVMANQDPIAV

SEQ ID NO: 468 - protein, 3579 aa, Drosophila melanogaster
MQTREFPQRPLGLLLVLLVVLLQSSLIKSYLIIVHEDTPPGTVIFNASVYKLGSERHYKINAHKSANFVHHLVSVNHKDGQIQLRKALKCDGIYYPNLFTFYVDSTSNRLRSIDYYSLPVRIFVSGHSCNEDRRIEQELHHHHYEEEDNTGYSKRRRRRSTQEMIQLNGNQLEEVFRQNSTEFRAGDLIFGDSFDNEMRHRILSRKRRAVGSPDPLHLQPALHRRISDAKQWISETYASYAIHTTDKWNQICLRRSQFINSLNAFLPRSVCQHCKVSFLDVNDERFAIEHQSRDLVASRDVCIAESMWKVSITFNIRCDRRDIVDSDHRLKIVYHHQEFNDTDIARRVRRELRNQSPYFEQALYVASVLEEQPAGAAVTTVRARDPEDSPVVYSMVSLLDSRSQSLFKVDSRTGVVTTSASLDRELMDVHYFRVVATDDSFPPRSGTTTLQVNVLDCNDHSPTFEAEQFEASIREGATVGSTVITLRATDQDIGKNAEIEYGIEAVTDGAGLAQDQEMPIFRIDSRSGVISTRSSLDRETSDSYHLLVTAADLASAQSERRTATASVQVKVLDDNDNYPQFSERTYTVQVPEDQWGGTEDNTVAHIRATDADQGNNAAIRYAIIGGNTQSQFSIDSMSGDVSLVKPLDYESVRSYRLVIRAQDGGSPSRSNTTQLLVNVIDANDNAPRFYTSQFQESVLENVPVGYNIIRVQAYDSDEGANAEITYSISERDDNFPLAVDPRTGWVQTIKPLDREEQGRFAFQVVAKDGGVPPKSASSSVVITVQDVNDNDPAFNPKYYEANVGEDQPPGTPVTTVTATDPDEDSRLHYEITTGNTRGRFAITSQNGRGLITIAQSLDYKQEKRFLLTVAATDSGGRSDTATVHINITDANNFAPIFENAPYSASVFEDAPVGTTVLVVSATDSDVGVNAQITYSLNEESINGLGSPDPFSINPQTGAIVTNAPLDRETTSGYLLTVTAKDGGNPSLSDTTDVEIGVTDVNDNAPAFKSPLYQASILEDALVGTSVIQVAASDPDVGLNGRIKYLLSDRDIEDGSFVIDPTSGTIRTNKGLDRESVAVFHLTAIAVDKGSPPLSSTVEVQIRLEDVNDSPPTFASDKITLYVPENSPVGSVVGEIHAHDPDEGVNAVVHYSIIGGDDSNAFSLVTRPGSERAQLLTMTELDYESTRKRFELVVRAASPPLRNDAHIEILVTDVNDNAPVLRDFQVIFNNFRDHFPSGEIGRIPAFDADVSDKLHYRILSGNNANLLRLNSSSGGLVLSPQLNTNVPKFATMEVSVSDGINEAKAIMQLSVRLITEDMLFNSVTVRLNEMTEEAFLSPLLNFFLDGLAAIIPCPKEHIFVFSIQDDTDVSSRILNVSFSARRPDVSHEEFYTPQYLQERVYLNRAILARLATVEVLPFDDNLCVREPCLNFEECLTVLKFGNASEFIHSDTVLFRPIYPVNTFACSCPEGFTGSKEHYLCDTEVDLCYSDPCQNGGTCVRREGGYTCVCPSTHTGQNCETGVGHLRPCPSETCEGGLSCLSNYPSSQPPPYTATCELRARAFGRNSFLTFESLKQRHRFNLKLRFATVQENGLLLYNGRYNELHDFIALEIHEGHVSFSFSLGDHSERISVIQEAKVSDGKWHQVEVVYLNRSVTLVLDNCDTAIALSGQLGDRWSCANRTTLKLDKRCSLLTETCHRFLDLTGPLQVGGLPRIPAHFPVTNRDFVGCISDLRIDDRFVDLNSYVADNGTLAGCPQKAPLCQSEPCFNGGTCREGWGTYSCECPEGYAGNSCQDNIPAPWRFSGDGSLSFNPLLRPIQLPWTTSFSLRTRQKEAFLLQIQIGQNSSAAVCLRQGVLYYIFDGEPMYLAGAFLSDGEWHRVEIRWQQGSEIHFSVDYGQRSGSVPMSQKVQGLYVGKIVMGSPDGSIGAVPEASPFEGCIQDVRIGAGQSVLSRPTIRENVEDGCESRAQCPDHCPNHSSCQSSWDLSTCECDSGYVGTDCAPICTVRPCASGVCRANTSLPRGYDCECNSSSRHGDYCEKELQQPCPGGWWGERVCGPCRCDLAQGYHPDCNKTTGQCYCKTNHYQPPNETACLSCDCYSIGSFSGACNPLTGQCECREGVIGRRCDSCSNPYAEVTLSGCEVVYDACPRSFAGGVWWPRTPLGGVAIEGCPPPARGKGQRSCDVQSGSWNTPDMYNCTSEPFVELRRQLSQLEKLELELNSFVAIKMAEQLRKACEAVDRRGASKDQKISGNGRPNRRYKMESSFLLSNGGNVWSHELEMDYLSDELKFTHDRLYGADLLVTEGLLQELINYELMQSGLNLSHSQDKYFIKNLVDAASVILDRKYEAEWRRATELIQRGPDDLVDAFNKYLVVLARSQHDTYTSPFEIVQPNMALGLDIVTTESLFGYEPEQLSEYHRSKYLKPNAFTTESVVLPDTSGFLQHSARQRPVISFPKYNNYILDRRKFDQHTKVLVPLEMLGITPPESDEISQSGRRGSSHDHRAIVAYAQYKDVGQLLPDLYDETITRRWGVDVELATPILSLQILVPSMEREQETQRLEIPSRKIFSSSSPSSSSSSGSTEQQFVEVFDVPKAPTSSSEQQIEDIRITAHEIPPPVSSVEQQEASSDEDGEEREPHIRLNLDDIEFHGNSGEEVISPDSPEMLNPNYEGVSSTGSDEQPKGENEAVYRDRRLVKRQVEITYPSEQMQQTEQVVYRSLGSPHLAQPIKLQMWLDVDSARFGPRSNPQCVRWNSFTNQWTRLGCQTEIPDFDGDFNPAAQQAILVNCSCTHISSYAVIVDVIDPEDIPEPSLLVQITSYSAFLVSLPLLLGVLLALALLRGQQTNSNTIHQNIVLCVFCAELLFFVGMQSRRQLLESEFPCKLTAICLHYFWLAAFAWTTVDCVHLYRMLTEMRDINHGPMGFYFAMGYGAPAIVVGLSVGVRAHEYGNSLFCWLSVYEPVVWWLVGPIAGMSVVNLLILFVSVKAAFTLKDHVLGFGNLRTLLWLSVVSLPLMGVMWVLAVLAASEHSQLLSLLLSGVVLLHALFCLIGYCIINKRVRENLQRTCLRCMGRKVPLLDSSMVVSNSSHNVNAAARPSNFLASGYDTTTRRNIGISASSTTSRSTAKTSSSPYSDGQLRQTSTSTSNYNSASDAPSFLRGFESSTTGRSRGGEEKPSRRQRKDSDSGSETDGRSLELASSHSSDDDESRTARSSGTHRSTAVSSTPAYLPNITEHVQATTPPELNVVQSPQLFPSVNKPVYAPRWSSQLPDAYLQSPPNIGRWSQDTGSDNEHVHGQAKMTISPNPLPNPDLTDTSYLQQHHNKINMPPSILENIRDAREGYEDSLYGRRGEYPDKYGSYKPPSHYGSEKDYPGGGSGSQTIGHMRSFHPDAAYLSDNIYDKQRTLGSGYLGAKSESPYLSKDRITPDIYGSRDGHYSLKRQPAYATDSLHSVHSLLKNDYHQQQQQQQQHHLQDRLSEGSDKNGYHFPYTAEEDHLPARKLSHTQPPSLHGSQLMQPPGVGLVNDVNNPGLMGRHTLNGGSRHSSRASSPPSTMVAPMQPLGPLTSITDTERNIDDDETTV

SEQ ID NO: 469 - protein, 2731 aa, Trichinella pseudospiralis
MLVGVLCCSLLFQASLFNSAAVYPQSTLLRKVLYVNSTCIGAGRPVFPSFDRWLLKRFNVPATAVENIHLTPSRTFLFSNGHLYLKNSICLGEWFITTVDGELSTGKSKGTVSAFSVQLKLRRRRRASRHRRAQSNDGDQWSGFSKSHYEVSVLEEQEPPISLLNFAQLSSAANVEALSSCSVTGAGNVQSQNLFTVEKETGQLITTGRLDREQADKHTLRITCYETTTNGRRSTTAIVLVNVLDVNDHEPVFERSNYAASISESVEPGTTVLHVHAQDEDAGQNGRIQYSVQRTNPATPLPFSLGLDDGVLRVEKPLDRETCPFYRFEVLACDQPLTITERLCAKALVEVTVDDENDNAPEFEQSSYVVEIDENLDPNDKPIIANVMATDRDFGHNGEVKYSIVSGNAEGRFSIDYNTGEVRLVGRVDYRQTDHYELVIRAQDSATFSLSNTTLLEIRIRDVNDHAPQFYAPVFQESVREDVPVGYRLLRLAAYDLDNGRNSEIRFRFTGPQADNCPLEVDSVTGWVTVAKPLDRELEPTIELQVEAVDLGNPPMASTAKLIVNVLDVDDNVPVFPEKQLNVSVPETARRGSLLLRITAHDPDDNSGRLQYNIISGNDDRTFILLNEENNYCSLAVDQPLSYTSKPIHVLTIKVTDSAGHWDTMTVRVQVEDVNSAPTFAEHSSTIHVRESEPVGSTVTVVRATDPDDGENARLQYQLEGGEPVFAIEPSTGVLFVNGTLDRESQSRFKLKVIATDHGQPPLSGSMDLEVVLDDVNDNAPVFSRSRYVTNVSEDAAVGVSLLHLTARDSDYGINSRITYHFSDEDPENDAFQIDPSSGVVRVAKPLDRERRAVYEITVLAKDKGEPPLTGRTALVINVDDVNDNAPKFDREAYQFEVYENVPIGTIVGHVLAVDPDIGEHALVSYKILGGDDAAAFEIHSPMSKSEGMNLVTRTELDFESDRRTYQFHIQASSGQLSSMAEVLVRVLDLNDHEPVFNDFYLVVYNHESDPWNKDQSNRPIGRVPAFDLDLNDTLYYKIAAGNEADLIQLDSNTGELRLSAALNTNRRIRLLLLIQVSDGINVVQATCTVIVEMITNSALLNSVTVRISGLTINSFLNPTAYGRLLDSLSALIPSDRRDVLIFSVRQDNKLHGEPTLNVSLVLRKANSDRFLSGEELHELVNFNRKRLSEASNLNILPLADELCSREPCLNNERCRNVLKFDGTGDFIVTENFIFKPVHCISTFICECPIGFAELTKQRPGCDIEINLCYSSPCKAGGTCLSRENGYSCICRPDFTGKNCEFPISNSYCIADICHGGSVCTLVQGKQKCRNCTYDADSTNEYCELTTRTFQPNSFVEFPTLNQRSRFNITFQFTTAVLDGMLFYAGRQKAENDFIVLELANGRLKLSMSLGEFDIKVLNLDSDYTLNDGQWHKVQVIYFNRTVTLILDDCDPFLALNPNRIFRYSQCAAHMEFKLDEKCNDPMVPCYRFLDITSPLYLGGLPSRNRHQRFRIMPIGFVGCMSHLYIDHKMINLNHYISNQMTVPGCAAMTKNCRRNPCQRNSACQGIWEDYVCKCPTDYAGKNCSEYVGKPISLPTSSSSVSFKVPPHAEIPLVFGIQFRTAQTDADIVVVELTNGKKIILQITDQLASVTLERKHQQLTQRLVSDSKWHSLLCEMQTDQIILNVDYVYQLTIPLSEKLNGIVKKIKINVASSKNNNNHNHPSNPFTGCLKGAFVDKPMQNKKTYLQILHQKNVIKQCTIPDNFCPKRDANGNCMNLCTLHPCLNGGTCNEQWNSYVCQCVENFTGRNCEHRLSTIGGRCPKGWWGNSTCGPCNCDTTKGYDANCDKYTGICKCTDKTYFDDEKKQCTPCNCFYPAGALNMSCNSETGQCHCRGNAVGKRCDICTDPRAQISRISGYCEIVTNGCPENWMSDILWPAIKLNKTSTKPCPRGWQGRAMRYCNAKGFWEKPRLENCTTAEFQTLENKIKDLQSNFKIDPITITAVAEKLKNATQRKSLYGHDLFAVGRILSKILTLELSDQHALPAAYQHDRNFASNIIASLDEAFSVNVRQNAGDADGQFLKQTLELVNQFHDYGIKIAAYQQKSHVDSMEYNGKSVVYAIQTVDPRNSDFQRIATLGKSKKSVAIQLDIQPKVKDLHKARTLFYAIYENVHDAELQRLRPSFAKRNVHNIHSPLLSVGVIDNAGEQVISIEKPAFFTFPLPSWMKNNYLIPFCMFWDAKNTYKDDDDDKSEPKWSTQGCYVDYFNRSHVICACNHLSTFAVSMRDFMATDAVLSYFALTVTTLSMVIILTIFICLIFTKQRENVFRNASMLISIFCYGITILLFDMFSRASNFVLKCSVIGNALLFVNVALFTWLVVVPVEIFKTSTPLKQTNNYYTWLRHMLIWTIPTVYIAIRILKDQFKATHENCWFSFYDSTLIFFAAPVVVLMLLSLYASTMALIFDCKHKQKLFPNGNKNRLYIFICFQLGIVAQWWFSYFAFNLTSYGLYYSYYGMSLVNMPLAALLAFSIIVISTQTSEKANKCDAKQTADADLWLSMNVSQFEMSMKQSTVSDACYAEEPTETDRLMMTTVDGHEIHQFSSEDMSLQNLKHDEKIYWQKAYAEQQSLDSSRVYLLEKVCNSESGQPYPENSWPKLPMQTHGCGSPRGRPVALITGTNRSQLGGLPSRRPSIGHSPTLPSSGQISPAILSSPIKVLQYGTSAHSSPVLEIGGS

SEQ ID NO: 470 - protein, 3189 aa, Cyphomyrmex costatus
MARWRWMLLMLTTIWTLSDGYLTVLPSSTPVGTVVFEAGVPQLGGRRKYEASSERTAWFARKLLKVHPHTGRVTLAKTLSCEGLQYPRVFTFYVDSTSSRLGRPTIDYYSLPLRILITGCGGENHDLAATRGWMAETLASYAMPSTDRFLIAKKKKKKLFWENNGQNSTLTQVFTEVCLRTSQLVAALRDFLPQTTLKECETRWGGVADPRFLVEGAAGDLVSATEQCLVDPLWKVSVSMNLRCTGDSRLTDAEHRLKIVFHHHQLDDTDLGRRVRRELKNQSPYFEQHLYLAAVEEEKEPGMYVTSVKARDPENGAVRYSMSSLVDARSQALLALDPVTGRVTTRARLDRENVDVHYFRVLAVDDSFPPRTGTTTLQVNVLDANDHTPSFEGPEYDASVREGVPVGSTVITVKATDQDTGRNAEVEYSIVSITAGNSITHMEDTATFRIDPRSGVVTTRTPLDREQTEIYTVMLSVTDQATPPSTRRSANATLVVRVLDDNDNYPQFTERTYSATVPEDLDYTTNPVIARIRAMDADAGANAAVRYAIIGGNTQNTFSIDSMSGDVALVKPLDYESTRSYKIVIRAQDGGSPARSNTTQLLVMVKDVNDNAPRFYTSHFQESVSENVPLGYSILRVQAYDADEGNNALIKYTIGARDFTGASTENFPITVKAETGWIYTTKQLDREQCSKYQFTVIAADSGEEPKSASATVFLTVTDVNDNDPYFEPKTYEAVVSEDSLAGTPVTTVTATDPDEDSRIHYEITGGNTRGRFSIASQNGRGLITIAQTLDYKQEKRFVLTVTASDSGSRTDTALVYVNVSDANNYSPEFENAPYSVSVFEDAPIGVTVLVVSATDADVGKNAQITYSLATDNGEQVITEFTINPQTGAITTTKALDRELVPSYLLTVTARDGGVPSLSDTTDVEISVTDVNDNAPVFEAPQYQGSILEDVLLSTSVLRVSATDADTDLNGRVRYGLEDDGDGAFTIDSTTGIIRTAKILDRESVAYYVLKAVATDRGSPALSSVVPVTIKIEDINDSPPAFENDKIILYIAENSPIGSTVGEIYAHDPDEGPNAVVQYSIIGGEDSNSFSLNVRQGADRAELITLEELDYESPKKKFELVVRAASPPLRSDAVVQILVTDVNDNAPVLKDFQIIFNNFKDFFPTVSIGRIPAVDADVTDNLVYSILSGNNANLIDLNRTTGEIRLSPQLNTNVPRVATMEVAVTDGINEAKATMTLSVRLITDEMLLNSITVRLDDMTVEAFLSPLLGYFLDGLAAIIPCPRENIFLFSVQEDANVHGKILNVSFSARKVEPGTVDEFYSPQFLQERVYLNRGILARLATVTVLPFDDNLCVREPCLNFEECLTVLKFGNASGFASSDTVLFRPIYPVTTFACRCARGFTGSREAYMCDTEVNLCYSNPCMNGGICHRREGGYSCTCQPDFTGVNCEISMNRNACSPGICKSGSQCTVKNTAGFTCEGCPVSALESVTPFCELKARSFGPATFLTFASLKQRHRLHLRLKFATELVDGLLLYNGRYNERHDFIALEIVDSRVQFSFSLGDEVTRAMASVPGGVSDGQWHEVVVSYINRTVTVSLDDCDVALALKHGERLGPKWTCAGRSERVLEDRCGFVTETCHRFLDLTGPLQLGGLPSIPSSFQIRNKDYVGCISDLYIDHVFVDLNSFVADNGTNAGCPEKAAFCASSPCRNNGKCREIWSGFVCECEHNFAGPTCAEEIGAPYNFRGDGMLGFNPLLRPIQLPWMTALSLRTRARQAFVMSVQIGQNSSVLLEIRNGKLVVSLDGADVIRTGGIVADGEWHRMEIVWQSGHVSLDTDYRERPATVPLPAKLQGLYVGRILVGGSDQATNIDLPFFNGCLQDIRIGTNQSVLQRPTIQENVNAGCPSETHCNLECPQASICIAKWQSSECVCAAGHVGRDCERICNLEPCSDVGICIENMTDLRRGYRCECASSDISGEYCETKSEQPCPATWWGSPICGPCHCDETKGYDPACNKTTGECHCKENHYQPNGRKECIPCECYTTGSFGPRCDTETGQCRCRTGVIGRSCTDCPNSYAEVTLRGCEVVYDGCPRSYSDGLWWPRTLFGLTAIEDCPGTAEGKTSRSCDDKLGGWQPPDLFNCTSEAFIEHRHQLAALETKDLTLNTYVAVKMAKDVHRAVNITREMYGVDLLVTESLLVALLRYEESLVGLNLTHSQDKDYVTHLIGIAGAILRSKYKEKWEKIEELNGDSPDKILDAMARYLKTLTASQHDTFTNPFEVVNDNVVLGLDIVTSESLFGYETIEYKEDPTLSTARPAEADRKVILPDTSAFLSSSTHFGPSINFPKYNNYMADPSRFDPHSKVQVPLNTLGIKPVIQGELNVKNSLNNRKAVLSYVQYKELGALLPQRFDDSVSVRWGVEVAVGSPVMTVSVLVPSDDGYESLTGIPLQSPIQVRLWLHENNDFKTRTNPQCVHWSTARGIGEWSRMGCTTEIEDNSLSFGTIVNCSCMKLSTFAILTDVLDLEYVPEPSLLEDVTSYSAFMLALPLLLSALLILALIRGGGTNSNSIHKNLVLCVFMAEILYLIALKARNPLISNEFPCKLTAIGLHYTWLSTFAWTLVDSVHLYRMLTEMRDVNHGQMRFYYTMGYGLPAVIVGLTIGVRADQYGNFYFCWLSIYETVIWALIGPVCAAVLVNFCILVMCIRAAFTLKEHIMGFGNLRTLLWLSVASLPLLGSTWTLAVLNASENSSMLSYLLSVAIVVHAAFSLIGYCFINSRVRRNLYQSLLRCIGKKAPLLEGSMGNGSSSQNVNGHSRSALAYSSTYSGAESACKRVHVGVSTSSTTSRSTNKTGSSPYRSDTHLRHTSTSTSNYNSDRDPYLSSRSHRSALNSRQESTEIRGQRRESESDSDGSQAEGGGRSLDLASSHSSDEDDVTSRSHRNMGVSTQQHVTHSYLPNIHTNPAEHLNILCSNTELFPNIKPIYAPRWSSQLPEAYLSSNVMDVRSSQWSGGTMSDNEIASNKTSSPNPLPYPEINSPQKNQPDENYSEGEEKMHHLGEKYLFPYTAEEDHTVSPTPYMLSMSSRILASSMSHHSQNSNHENLSGSEQRYGSLKRGQSLHGSQHDNLSGSERYGSLKRGKMGTPTVLEDRPEYILPMSGRILSSSLTHDLQHSNELAALRQQQQQQQQQYEQTIAETE

SEQ ID NO: 471 - protein, 3584 aa, Drosophila ficusphila
MRTGEPPHRWSHLGLLPLVLLALLLLPSSLVESYLIIVHEDTPPGTIIFNASVYKLGSERHYKINAHKSANFVHHLVSVSHKDGQIQLRKALKCDGIYYPNLFTFYVDSTSNRLRSIDYYSLPVRIFISGHSCNEDRRIEQELHHHHYEEEDNTGYSKRRRRRSTQEIIQLDGNQLEEAFRQNSTEFRAGDLIFGDSFENEMRHRILSRKRRAVGSSDPLHLQPALHRRISDAKQWISETYASYAIHTTDKWNQICLRRSQFINSLNAFLPKSVCQHCKVTFLDVNDERFAIEHQSRDLVASRDVCIAESMWKVSITFNIRCDRRDIVDSDHRLKIVYHHQEFNDTDIARRVRRELRNQSPYFEQALYVAAVLEEQPAGSAVTTVRARDPEDSPVVYSMVSLLDSRSQSLFKVDSRTGVVTTSASLDRELMDVHYFRVVATDDSFPPRSGTTTLQVNVLDCNDHSPTFEAEQFEASIREGATVGSTVITLRATDQDIGKNAEIEYGIEAVTDGAGLAQDQEMPIFRIDSRSGVISTRSSLDRETSDSYHLLVTAADMASAQSERRTATASVQVKVLDDNDNYPQFSERTYTVQVPEDQWGGTEDNTVAHIRATDADQGNNAAIRYAIIGGNTQSQFSIDSMSGDVSLVKPLDYESVRSYRLVIRAQDGGSPSRSNTTQLLVNVIDANDNAPRFYTSQFQESVLENVPVGYNIIRVQAYDSDEGANAEITYSISERDDNFPLAVDPRTGWVQTIKPLDREEQGRFAFQVVAKDGGVPPKSASSSVVITVQDVNDNDPAFNPKYYEANVGEDQPPGTPVTTVTATDPDEDSRLHYEITTGNTRGRFAITSQNGRGLITIAQSLDYKQEKRFLLTVAATDSGGRSDTATVHINITDANNFAPIFENAPYSASVFEDAPVGTTVLVVSATDSDVGVNAQITYSLNEESINGLGSPDPFSINPQTGAIVTNAPLDRETTSGYLLTVTAKDGGNPSLSDTTDVEIGVTDVNDNAPTFKSPLYQASILEDALVGTSVIQVAASDPDVGLNGRIKYLLSDRDIEDGSFVIDPTSGTIRTNKGLDRESVAVFHLTAIAVDKGSPPLSSTVEVQIRLEDVNDSPPTFASDKITLYVPENSPVGSVVGEIHAHDPDEGVNAVVHYSIIGGDDSNAFSLVTRPGSERAQLLTMTELDYESTRKRFELVVRAASPPLRNDAHIEILVTDVNDNAPVLRDFQVIFNNFRDHFPSGEIGRIPAFDADVSDKLHYRILSGNNANLLRLNSSSGGLVLSPQLNTNVPKFATMEVSVSDGINEAKAIMQLSVRLITEDMLFNSVTVRLNEMTEEAFLSPLLNFFLDGLAAIIPCPKEHIFVFSIQDDTDVSSRILNVSFSARRPDVSHEEFYTPQYLQERVYLNRAILARLATVEVLPFDDNLCVREPCLNFEECLTVLKFGNASEFIHSDTVLFRPIYPVNTFACSCPEGFTGSKEHYLCDTEVDLCYSDPCQNGGSCVRREGGYTCVCPTTHTGLNCETGVNQLRPCPSDSCEGGLSCLSNYPSSQPPPYTAACELRARAFGRNSFLTFESLKQRHRFNIKLRFATVQENGLLLYNGRYNELHDFVALEIHEGHVSFSFSLGDHSERVSVIQEAKVSDGKWHEVEVVYLNRSVTLVLDNCDTAIALSGQLGDRWSCANRTVLKLDKRCSLLTETCHRFLDLTGPLQVGGLPRIPAHFPVANRDYVGCISDLRIDDRFIDLNSYVADNGTLAGCPQKAPLCQSEPCFNGGTCREGWGTYSCECPEGYAGNSCQDNIPAPWRFSGDGSLSFNPLLRPIQLPWTTSFSLRTRQKEAFLLQIQIGQNSSAAVCLRQGILYYIFDGEPMFLAGAFLSDGEWHRVEIRWQQGSEIHFSVDYGQRSGSVPMSQKVQGLYVGKIVMGSPDGSIGSVPEASPFEGCIQDVRIGAGQSVLSRPTIRENVEDGCESRAQCPDHCPNHSSCQSTWDLSTCECDSGFVGADCAPICTVRPCASGVCRANTSLSRGYGCECNTSSRHGDYCERELQQPCPGGWWGERVCGPCRCDLAQGYHPDCNKTTGQCYCKTNHYQPPNETACLSCDCYSIGSFSGACNPLTGQCECREGVIGRRCDSCSNPYAEVTLSGCEVVYDACPRSFAGGVWWPRTPIGGVAIEGCPAPARGKGQRNCDAQSGSWNTPDMYNCTSEPFVELRRQLSQLEKLELELNSFVAIKMAEQLRKACETVDRRGSSKDQKMPGSGRPNRRYKMESSFLLSNGGNVWSHELEMDYLSDELKFTHDRLYGADLLVTEGLLQELINYELMQSGLNLSHSQDKYFIKNLVDAASVILDRKYEAEWRRATELIQRGPDDLVDAFNKYLVVLARSQHDTYTSPFEIVQPNMALGLDIVTTESLFGYEPEQLSEYHRSKYLKPNAFTTESVVLPDTSGFLQHSARQRPVISFPKYNNYILDRRKFDQHTKVLVPLEMLGITPPESDEVSQSSRRGGSHDHRAIVAYAQYKDVGQLLPDLYDETITRRWGVDVELATPILSLQILVPSMEREQETQRMEIPPRKISSSSTSSSSGSTEQQFVEVFDVPKAPTSSSEQQIEDIRITAHEIPPPVSSGEQMEASSGEDGEEREHHIRLNPDDIEFHGNSGEEIVSPDSPEILNPNYEGVSSTGSDEQPKGENEAVYRDRRLVKRQVEITYPSEQMQQSEQVVYRSLGSPHLAQPIKLQMWLDVDAARFGPRSNPQCVRWNSFTNQWTRLGCQTEIPDFDGDFNPAAQQAILVNCSCTHISSYAVIVDVIDPEDIPEPSLLVQITSYSAFLVSLPLLLGVLLALALLRGQQTNSNTIHQNIVLCVFCAELLFFVGMQSRRQLLESEFPCKLTAICLHYFWLAAFAWTTVDCVHLYRMLTEMRDINHGPMGFYFAMGYGAPAIVVGLSVGVRAHEYGNSLFCWLSVYEPVVWWLVGPIAGMSVVNLLILFVSVKAAFTLKDHVLGFGNLRTLLWLSVVSLPLMGVMWVLAVLAASEHSQLLSMLLSGVVLLHALFCLIGYCIINKRVRENLQRTCLRCMGRKVPLLDSSMVVSNSSHNVNGAARPSNFLAGGYDTTTRRNIGISASSTTSRSTAKTSSSPYSDGQLRQTSTSTSNYNSASDAPSFLRGFESSTTGRSRNTGEEKPSRRQRKDSDSGSETDGRSLELASSHSSDDDESRTARSSGTHRSTAVSSTPAYLPNITEHVQATTPPELNVVQSPQLFPSVSKPVYAPRWSSQLPDAYLQSPPNIGRWSQDTGSDNEHVHGQAKMTISPNPLPNPDLTDTSYLQQHHNKINMPPSILENIRDARDGYEDSLYGRRGEYPDKYGSYKPPSHYGSEKDYPGGGSGSQTIGHMRSFHPDAAYLSDNIYDKQRTLGSGYLGAKSESPYLSKDRITPDIYGSRDGHYSLKRQPTYATDSLHSVHSLLKNDYHQQQQQQLHQQQHHLQDRLSEGSDKNGYHFPYTAEEDHLPARKLSHTQPPSLHGSQLMQPPGLGLVNDVNNPGLVARHPLNGGSRHSSRASSPPSSMVAPMQPLGPLTSITDTERNIDDDETTV

SEQ ID NO: 472 - protein, 3034 aa, Mus musculus
MAPSSPRVLPALVLLAAAALPALELGAAAWELRVPGGARAFALGPGWSYRLDTTRTPRELLDVSREGPAAGRRLGLGAGTLGCARLAGRLLPLQVRLVARGAPTAPSLVLRARAYGARCGVRLLRRSARGAELRSPAVRSVPGLGDALCFPAAGGGAASLTSVLEAITNFPACSCPPVAGTGCRRGPICLRPGGSAELRLVCALGRAAGAVWVELVIEATSGTPSESPSVSPSLLNLSQPRAGVVRRSRRGTGSSTSPQFPLPSYQVSVPENEPAGTAVIELRAHDPDEGDAGRLSYQMEALFDERSNGYFLIDAATGAVTTARSLDRETKDTHVLKVSAVDHGSPRRSAATYLTVTVSDTNDHSPVFEQSEYRERIRENLEVGYEVLTIRATDGDAPSNANMRYRLLEGAGGVFEIDARSGVVRTRAVVDREEAAEYQLLVEANDQGRNPGPLSASATVHIVVEDENDNYPQFSEKRYVVQVPEDVAVNTAVLRVQATDRDQGQNAAIHYSIVSGNLKGQFYLHSLSGSLDVINPLDFEAIREYTLRIKAQDGGRPPLINSSGLVSVQVLDVNDNAPIFVSSPFQAAVLENVPLGHSVLHIQAVDADAGENARLQYRLVDTASTIVGGSSVDSENPASAPDFPFQIHNSSGWITVCAELDREEVEHYSFGVEAVDHGSPAMSSSASVSITVLDVNDNDPMFTQPVYELRLNEDAAVGSSVLTLRARDRDANSVITYQLTGGNTRNRFALSSQSGGGLITLALPLDYKQERQYVLAVTASDGTRSHTAQVFINVTDANTHRPVFQSSHYTVSVSEDRPVGTSIATISATDEDTGENARITYVLEDPVPQFRIDPDTGTIYTMTELDYEDQAAYTLAITAQDNGIPQKSDTTSLEILILDANDNAPRFLRDFYQGSVFEDAPPSTSVLQVSATDRDSGPNGRLLYTFQGGDDGDGDFYIEPTSGVIRTQRRLDRENVAVYNLWALAVDRGSPNPLSASVGIQVSVLDINDNPPVFEKDELELFVEENSPVGSVVARIRANDPDEGPNAQIMYQIVEGNVPEVFQLDLLSGDLRALVELDFEVRRDYMLVVQATSAPLVSRATVHIRLLDQNDNPPELPDFQILFNNYVTNKSNSFPSGVIGRIPAHDPDLSDSLNYTFLQGNELSLLLLDPATGELQLSRDLDNNRPLEALMEVSVSDGIHSVTALCTLRVTIITDDMLTNSITVRLENMSQEKFLSPLLSLFVEGVATVLSTTKDDIFVFNIQNDTDVSSNILNVTFSALLPGGTRGRFFPSEDLQEQIYLNRTLLTTISAQRVLPFDDNICLREPCENYMKCVSVLRFDSSAPFISSTTVLFRPIHPITGLRCRCPPGFTGDYCETEIDLCYSNPCGANGRCRSREGGYTCECFEDFTGEHCQVNVRSGRCASGVCKNGGTCVNLLIGGFHCVCPPGEYEHPYCEVSTRSFPPQSFVTFRGLRQRFHFTVSLAFATQDRNALLLYNGRFNEKHDFIALEIVEEQLQLTFSAGETTTTVTPQVPGGVSDGRWHSVLVQYYNKPNIGHLGLPHGPSGEKVAVVTVDDCDAAVAVHFGSYVGNYSCAAQGTQSGSKKSLDLTGPLLLGGVPNLPEDFPVHSRQFVGCMRNLSIDGRIVDMAAFIANNGTRAGCASQRNFCDGTSCQNGGTCVNRWNTYLCECPLRFGGKNCEQAMPHPQRFTGESVVLWSDLDITISVPWYLGLMFRTRKEDGVLMEATAGTSSRLHLQILNSYIRFEVSYGPSDVASMQLSKSRITDGGWHHLLIELRSAKEGKDIKYLAVMTLDYGMDQSTVQIGNQLPGLKMRTIVIGGVTEDKVSVRHGFRGCMQGVRMGETSTNIATLNMNDALKVRVKDGCDVEDPCASSPCPPHSHCRDTWDSYSCICDRGYFGKKCVDACLLNPCKHVAACVRSPNTPRGYSCECGPGHYGQYCENKVDLPCPKGWWGNPVCGPCHCAVSQGFDPDCNKTNGQCQCKENYYKPPAQDACLPCDCFPHGSHSRACDMDTGQCACKPGVIGRQCNRCDNPFAEVTSLGCEVIYNGCPRAFEAGIWWPQTKFGQPAAVPCPKGSVGNAVRHCSGEKGWLPPELFNCTSGSFVDLKALNEKLNRNETRMDGNRSLRLAKALRNATQGNSTLFGNDVRTAYQLLARILQHESRQQGFDLAATREANFHEDVVHTGSALLAPATEASWEQIQRSEAGAAQLLRHFEAYFSNVARNVKRTYLRPFVIVTANMILAVDIFDKLNFTGAQVPRFEDIQEELPRELESSVSFPADTFKPPEKKEGPVVRLTNRRTTPLTAQPEPRAERETSSSRRRRHPDEPGQFAVALVVIYRTLGQLLPEHYDPDHRSLRLPNRPVINTPVVSAMVYSEGTPLPSSLQRPILVEFSLLETEERSKPVCVFWNHSLDTGGTGGWSAKGCELLSRNRTHVTCQCSHSASCAVLMDISRREHGEVLPLKIITYAALSLSLVALLVAFVLLSLVRTLRSNLHSIHKNLITALFFSQLIFMVGINQTENPFLCTVVAILLHYVSMGTFAWTLVENLHVYRMLTEVRNIDTGPMRFYHVVGWGIPAIVTGLAVGLDPQGYGNPDFCWLSLQDTLIWSFAGPVGTVIIINTVIFVLSAKVSCQRKHHYYERKGVVSMLRTAFLLLLLVTATWLLGLLAVNSDTLSFHYLFAAFSCLQGIFVLLFHCVAHREVRKHLRAVLAGKKLQLDDSATTRATLLTRSLNCNNTYSEGPDMLRTALGESTASLDSTTRDEGVQKLSVSSGPARGNHGEPDASFIPRNSKKAHGPDSDSDSELSLDEHSSSYASSHTSDSEDDGGEAEDKWNPAGGPAHSTPKADALANHVPAGWPDESLAGSDSEELDTEPHLKVETKVSVELHRQAQGNHCGDRPSDPESGVLAKPVAVLSSQPQEQRKGILKNKVTYPPPLPEQPLKSRLREKLADCEQSPTSSRTSSLGSGDGVHATDCVITIKTPRREPGREHLNGVAMNVRTGSAQANGSDSEKP

SEQ ID NO: 473 - protein, 3014 aa, Homo sapiens
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTGEHCEVDARSGRCANGVCKNGGTCVNLLIGGFHCVCPPGEYERPYCEVTTRSFPPQSFVTFRGLRQRFHFTISLTFATQERNGLLLYNGRFNEKHDFIALEIVDEQVQLTFSAGETTTTVAPKVPSGVSDGRWHSVQVQYYNKPNIGHLGLPHGPSGEKMAVVTVDDCDTTMAVRFGKDIGNYSCAAQGTQTGSKKSLDLTGPLLLGGVPNLPEDFPVHNRQFVGCMRNLSVDGKNVDMAGFIANNGTREGCAARRNFCDGRRCQNGGTCVNRWNMYLCECPLRFGGKNCEQAMPHPQLFSGESVVSWSDLNIIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTVRSVVVGGASEDKVSVRRGFRGCMQGVRMGGTPTNVATLNMNNALKVRVKDGCDVDDPCTSSPCPPNSRCHDAWEDYSCVCDKGYLGINCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEKP

SEQ ID NO: 474 - protein, 2920 aa, Mus musculus
MRTRAASAPLPTPLLPLLLLLLLLPPSPLLGDQVGPCRSLGSGGRSSSGACAPVGWLCPASASNLWLYTSRCRESGIELTGHLVPHHDGLRVWCPESGAHIPLPPSSEGCPWSCRLLGIGGHLSPQGTLTLPEEHPCLKAPRLRCQSCKLAQAPGLRAGEGSPEESLGGRRKRNVNTAPQFQPPSYQATVPENQPAGTSVASLRAIDPDEGEAGRLEYTMDALFDSRSNHFFSLDPITGVVTTAEELDRETKSTHVFRVTAQDHGMPRRSALATLTILVTDTNDHDPVFEQQEYKESLRENLEVGYEVLTVRATDGDAPPNANILYRLLEGAGDSPSDAFEIDPRSGVIRTRGPVDREEVESYKLTVEASDQGRDPGPRSSTAIVFLSVEDDNDNAPQFSEKRYVVQVREDVTPGAPVLRVTASDRDKGSNALVHYSIMSGNARGQFYLDAQTGALDVVSPLDYETTKEYTLRIRAQDGGRPPLSNVSGLVTVQVLDINDIRPPIFVSTPFQATVLESVPLGYLVLHVQAIDADAGDNARLEYSLAGVGHDFPFTINNGTGWISVAAELDREEVDFYSFGVEARDHGTPALTASASVSVTILDVNDNNPTFTQPEYTVRLNEDAAVGTSVVTVSAVDRHAHSVITYQITSGNTRNRFSITSQSGGGLVSLALPLDYKLERQYVLAVTASDGTRQDTAQIVVNVTDANTHRPVFQSSHYTVNGNEDRPAGTTVVLISATDEDTGENARITYFMEDSIPQFRIDGDTGAVTTQAELDYEDQVSYTLAITARDNGIPQKSDTTYLEILVNDVNDNAPQFLRDSYQGTVYEDVPPFTSVLQILATDRDSGLNGRVFYTFQGGDDGDGDFIVESTSGIVRTLRRLDRENVAQYVLRAYAVDKGMPPARTPMEVTVTVLDGNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELRLSRALDNNRPLEAIMSVLVSDGVHSVTAQCSLRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAKRVLPFDRQHLLREPCENYMRCVSVLRFDSSAPFIASSSVLFRPIHLVGGLRCRCPPGLTGDYCETEVDLCYSRTCGPHGRCRSREGGYTCLCRGCYTGEHCEASTHSGRCTPGVCKNGGTCVNLLVGGIKCDCPSGHFEKPFCQVTTRSFPARPFITFRGLHQRFHFTLALSFATKERNGLLLYNGRFNEKHDFVALEVIQEQVQLTFSAGESTTTVSPFVPGGVSDGQWHTVQLKYYNKPLLGQTGLPQGPSEQKVAVVSVDGCDTGVALRFGAMLGNYSCAAQGTQGGSKKSLDLTGPLLLGGVPDLPESFPVRMRHFVGCMKDLQVDSRHIDMADFIANNGTVPGCPTKKIVCDSSICHNGGTCVNQWNTFSCECPLGFGGKSCAQEMANPQRFLGSSLVAWHGLYLPISQPWHLNLMFRTRQADGVLLQAVTRGRSTITLQLRAGHVRLSMEGTGLQASSLHLEPGRANDGDWHHAQLALGASRGPGHAILSFNYGQQTAEGNLGPRLHGLHLSNITVGGVPGPASGVARGFRGCLQGVRVSETPEGVHSLDPSRGESINVEPGCSLPDPCDSNPCPTNSYYSNDWNSYSCSCVLGYYGDNCTNVCDLNPCEHQSVCTRKPNTPHGYICECLPNYLGPYCETRIDQPCPRGWWGHPTCGPCNCDVSKGFDPDCNKTSGECHCKEKHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSVTFSELKGFAERLQRNESGLDSGRSQRLALLLRNATQHTSGYFGSDVKVAYQLATRLLAHESAQRGFGLSATQDVHFTENLLRVGSALLDAANKRHWELIQQTEGGTAWLLQHYEAYASALAQNMRHTYLSPFTIVTPNIVISVVRLDKGNFAGTKLPRYEALRGERPPDVETTVILPESVFREMPSMVRSAGPGEAQETEELARRQRRHPELSQGEAVASVIIYHTLAGLLPHNYDPDKRSLRVPKRPVINTPAVSISVHDDEELLPRALDKPVTVQFRLLETEERTKPICVFWNHSILVSGTGGWSARGCEVVFRNESHVSCQCNHMTSFAVLMDMSRRENGEILPLKTLTYVALGVTLAALMLTFLFLTLLRALRSNQHGIRRNLTAALGLAQLVFLLGINQADLPFACTVIAILLHFLYLCTFSWALLEALHLYRALTEVRDVNASPMRFYYMLGWGVPAFITGLAVGLDPEGYGNPDFCWLSVYDTLIWSFAGPVAFAVSMSVFLYILSARASCAAQRQGFEKKGPVSGLRSSFTVLLLLSATWLLALLSVNSDTLLFHYLFAACNCVQGPFIFLSYVVLSKEVRKALKFACSRKPSPDPALTTKYTLTSSYNCPSPYADGRLYQPYGDSAGSLHSASRSGKSQPSYIPFLLREESTLNPGQVPPGLGDPSGLFLEGQAQQHDPDTDSDSDLSLEDDQSGSYASTHSSDSEEEEEEAAFPGEQGWDSLLGPGAERLPLHSTPKDGGPGSGKVPWLGDFGTTTKENSGSGALEERPRENGDALTREGSLGPLPGPSTQPHKGILKKKCLPTISEKSSLLRLPLEQGTGSSRGSSISEGSRHGPPPRPPPRQSLQEQLNGVMPVAMSINAGTVDEDSSGSEFLFFNFLH

SEQ ID NO: 475 - protein, 3312 aa, Homo sapiens
MMARRPPWRGLGGRSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 476 - protein, 3301 aa, Mus musculus
MARRPLWWGLPGPSTPVLLLLLLSLFPFSREELGGGGDQDWDPGVATTTGPRAQIGSGAVALCPESPGVWEDGDPGLGVREPVFMRLRVGRQNARNGRGAPEQPNAEVVVQALGSREQEAGQGPGYLLCWHPEISSCGRTGPLRRGSLPLDALSPGDSDLRNSSPHPSELLAQPDGSRPVAFQRNARRSIRKRVETSRCCGKLWEPGHKGQGERSATSTVDRGPFRRDCLPGSLGSGLGEDSAPRAVRTAPTPGSAPRESRTAPGRMRSRGLFRRRFLFERPGPRPPGFPTGPEAKQILSTNQARPRRAANRHPQFPQYNYQTLVPENEAAGTSVLRVVAQDPDPGEAGRLIYSLAALMNSRSLELFSIDPQSGLIRTAAALDRESMERHYLRVTAQDHGSPRLSATTMVAVTVADRNDHAPVFEQAQYRETLRENVEEGYPILQLRATDGDAPPNANLRYRFVGSPAVRTAAAAAFEIDPRSGLISTSGRVDREHMESYELVVEASDQGQEPGPRSATVRVHITVLDENDNAPQFSEKRYVAQVREDVRPHTVVLRVTATDKDKDANGLVHYNIISGNSRGHFAIDSLTGEIQVMAPLDFEAEREYALRIRAQDAGRPPLSNNTGLASIQVVDINDHAPIFVSTPFQVSVLENAPLGHSVIHIQAVDADHGENSRLEYSLTGVASDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSMNEDRPVGSTVVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVPVYELTAYAVDRGVPPLRTPVSIQVTVQDVNDNAPVFPAEEFEVRVKENSIVGSVVAQITAVDPDDGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNRTSGELRLSRKLDNNRPLVASMLVTVTDGLHSVTAQCVLRVVIITEELLANSLTVRLENMWQERFLSPLLGHFLEGVAAVLATPTEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASTSTLFRPIQPIAGLRCRCPPGFTGDFCETELDLCYSNPCRNGGACARREGGYTCVCRPRFTDCELDTEAGRCVPGVCRNGGTCTNAPNGGFRCQCPAGGAFEGPRCEVAARSFPPSSFVMFRGLRQRFHLTLSLSFATVQPSGLLFYNGRLNEKHDFLALELVAGQVRLTYSTGESNTVVSPTVPGGLSDGQWHTVHLRYYNKPRTDALGGAQGPSKDKVAVLSVDDCNVAVALQFGAEIGNYSCAAAGVQTSSKKSLDLTGPLLLGGVPNLPENFPVSHKDFIGCMRDLHIDGRRMDMAAFVANNGTMAGCQAKSHFCASGPCKNNGFCSERWGGFSCDCPVGFGGKDCRLTMAHPYHFQGNGTLSWDFGNDMAVSVPWYLGLSFRTRATKGILMQVQLGPHSVLLCKLDRGLLSVTLNRASGHTVHLLLDQMTVSDGRWHDLRLELQEEPGGRRGHHIFMVSLDFTLFQDTMAMGGELQGLKVKQLHVGGLPPSSKEEGHQGLVGCIQGVWIGFTPFGSSALLPPSHRVNVEPGCTVTNPCASGPCPPHADCKDLWQTFSCTCRPGYYGPGCVDACLLNPCQNQGSCRHLQGAPHGYTCDCVSGYFGQHCEHRVDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEDQGWLEPDLFNCTSPAFRELSLLLDGLELNKTALDTVEAKKLAQRLREVTGQTDHYFSQDVRVTARLLAYLLAFESHQQGFGLTATQDAHFNENLLWAGSALLAPETGHLWAALGQRAPGGSPGSAGLVQHLEEYAATLARNMELTYLNPVGLVTPNIMLSIDRMEHPSSTQGARRYPRYHSNLFRGQDAWDPHTHVLLPSQASQPSPSEVLPTSSNAENATASSVVSPPAPLEPESEPGISIVILLVYRALGGLLPAQFQAERRGARLPQNPVMNSPVVSVAVFHGRNFLRGVLVSPINLEFRLLQTANRSKAICVQWDPPGPTDQHGMWTARDCELVHRNGSHARCRCSRTGTFGVLMDASPRERLEGDLELLAVFTHVVVAVSVTALVLTAAVLLSLRSLKSNVRGIHANVAAALGVAELLFLLGIHRTHNQLLCTAVAILLHYFFLSTFAWLLVQGLHLYRMQVEPRNVDRGAMRFYHALGWGVPAVLLGLAVGLDPEGYGNPDFCWISIHEPLIWSFAGPIVLVIVMNGTMFLLAARTSCSTGQREAKKTSVLTLRSSFLLLLLVSASWLFGLLAVNHSILAFHYLHAGLCGLQGLAVLLLFCVLNADARAAWTPACLGKKAAPEETRPAPGPGSGAYNNTALFEESGLIRITLGASTVSSVSSARSGRAQDQDSQRGRSYLRDNVLVRHGSTAEHTERSLQAHAGPTDLDVAMFHRDAGADSDSDSDLSLEEERSLSIPSSESEDNGRTRGRFQRPLRRAAQSERLLAHPKDVDGNDLLSYWPALGECEAAPCALQAWGSERRLGLDSNKDAANNNQPELALTSGDETSLGRAQRQRKGILKNRLQYPLVPQSRGTPELSWCRAATLGHRAVPAASYGRIYAGGGTGSLSQPASRYSSREQLDLLLRRQLSKERLEEVPVPAPVLHPLSRPGSQERLDTAPARLEARDRGSTLPRRQPPRDYPGTMAGRFGSRDALDLGAPREWLSTLPPPRRNRDLDPQHPPLPLSPQRQLSRDPLLPSRPLDSLSRISNSREGLDQVPSRHPSREALGPAPQLLRAREDPASGPSHGPSTEQLDILSSILASFNSSALSSVQSSSTPSGPHTTATASALGPSTPRSATSHSISELSPDSEVPRSEGHS

SEQ ID NO: 477 - protein, 2923 aa, Homo sapiens
MRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSEFLFFNFLH

SEQ ID NO: 478 - protein, 3313 aa, Rattus norvegicus
MARRPLWWGLPGPSTPLLLLLLFSLFPSSREEMGGGGDQGWDPGVATATGPRAQIGSGAVALCPESPGVWEDGDPGLGVREPVFMKLRVGRQNARNGRGAPEQPNREPVVQALGSREQEAGQGSGYLLCWHPEISSCGRTGHLRRGSLPLDALSPGDSDLRNSSPHPSELLAQPDSPRPVAFQRNGRRSIRKRVETFRCCGKLWEPGHKGQGERSATSTVDRGPLRRDCLPGSLGSGLGEDSAPRAVRTAPAPGSAPHESRTAPERMRSRGLFRRGFLFERPGPRPPGFPTGAEAKRILSTNQARSRRAANRHPQFPQYNYQTLVPENEAAGTAVLRVVAQDPDPGEAGRLVYSLAALMNSRSLELFSIDPQSGLIRTAAALDRESMERHYLRVTAQDHGSPRLSATTMVAVTVADRNDHAPVFEQAQYRETLRENVEEGYPILQLRATDGDAPPNANLRYRFVGSPAARTAAAAAFEIDPRSGLISTSGRVDREHMESYELVVEASDQGQEPGPRSATVRVHITVLDENDNAPQFSEKRYVAQVREDVRPHTVVLRVTATDKDKDANGLVHYNIISGNSRGHFAIDSLTGEIQVMAPLDFEAEREYALRIRAQDAGRPPLSNNTGLASIQVVDINDHSPIFVSTPFQVSVLENAPLGHSVIHIQAVDADHGENSRLEYSLTGVASDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGMGLVTLALPLDYKQERYFKLVLTASDRALHDHCYVHINITDANTHRPVFQSAHYSVSMNEDRPVGSTVVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVPVYELTAYAVDRGVPPLRTPVSIQVTVQDVNDNAPVFPAEEFEVRVKENSIVGSVVAQITAVDPDDGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGHFLEGVAAVLATPTEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTNAPNGGFRCQCPAGGAFEGPRCEVAARSFPPSSFVMFRGLRQRFHLTLSLSFATVQPSGLLFYNGRLNEKHDFLALELVAGQVRLTYSTGESSTVVSPTVPGGLSDGQWHTVHLRYYNKPRTDALGGAQGPSKDKVAVLSVDDCNVAVALRFGAEIGNYSCAAAGVQTSSKKSLDLTGPLLLGGVPNLPENFPVSRKDFIGCMRDLHIDGRRVDMAAFVANNGTTAGCQAKSHFCASGPCKNGGLCSERWGGFSCDCPVGFGGKDCRLTMAHPYHFQGNGTLSWDFGNDMPVSVPWYLGLSFRTRATKGVLMQVQLGPHSVLLCKLDQGLLSVTLSRASGHAVHLLLDQMTVSDGRWHDLRLELQEEPGGRRGHHIFMVSLDFTLFQDTMAMGSELEGLKVKHLHVGGPPPSSKEEGPQGLVGCIQGVWTGFTPFGSSALPPPSHRINVEPGCTVTNPCASGPCPPHANCKDLWQTFSCTCWPGYYGPGCVDACLLNPCQNQGSCRHLQGGPHGYTCDCASGYFGQHCEHRMDQQCPRGWWGSPTCGPCNCDVHKGFDPNCNKTSGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGLRGTGAAVRLCDEDHGWLEPDFFNCTSPAFRELSLLLDGLELNKTALDTVEAKKLAQRLREVTGQTDHYFSQDVRVTARLLAYLLAFESHQQGFGLTATQDAHFNENLLWAGSALLAPETGDLWAALGQRAPGGSPGSAGLVRHLEEYAATLARNMDLTYLNPVGLVTPNIMLSIDRMEQPSSSQGAHRYPRYHSNLFRGQDAWDPHTHVLLPSQSPQPSPSEVLPTSSNAENATASGVVSPPAPLEPESEPGISIVILLVYRALGGLLPAQFQAERRGARLPQNPVMNSPVVSVAVFRGRNFLRGALVSPINLEFRLLQTANRSKAICVQWDPPGPADQHGMWTARDCELVHRNGSHARCRCSRTGTFGVLMDASPRERLEGDLELLAVFTHVVVAASVTALVLTAAVLLSLRSLKSNVRGIHANVAAALGVAELLFLLGIHRTHNQLLCTVVAILLHYFFLSTFAWLLVQGLHLYRMQVEPRNVDRGAMRFYHALGWGVPAVLLGLAVGLDPEGYGNPDFCWISIHEPLIWSFAGPIVLVIVMNGIMFLLAARTSCSTGQREAKKTSVLRTLRSSFLLLLLVSASWLFGLLAVNHSVLAFHYLHAGLCGLQGLAVLLLFCVLNADARAAWTPACLGKKAAPEETRPAPGPGSGAYNNTALFEESGLIRITLGASTVSSVSSARSGRAQDQDSQRGRSYLRDNVLVRHGSTAEHAEHSLQAHAGPTDLDVAMFHRDAGADSDSDSDLSLEEERSLSIPSSESEDNGRTRGRFQRPLRRAAQSERLLAHPKDVDGNDLLSYWPALGECEAAPCALQAWGSERRLGLDSNKDAANNNQPELALTSGDETSLGRAQRQRKGILKNRLQYPLVPQTRGTPELSWCRAATLGHRAVPAASYGRIYAGGGTGSLSQPASRYSSREQLDLLLRRQLSRERLEEVPVPAPVLHPLSRPGSQERLDTAPARLEPRDRGSTLPRRQPPRDYPGTMAGRFGSRDALDLGAPREWLSTLPPPRRNRDLDPQHPPLPLSPQRPLSRDPLLPSRPLDSLSRISNSRERLDQVPSRHPSREALGPAPQLLRAREDPASGPSHGPSTEQLDILSSILASFNSSALSSVQSSSTPSGPHTTATPSATASALGPSTPRSATSHSISELSPDSEVPRSEGHS

SEQ ID NO: 479 - protein, 2144 aa, Rattus norvegicus
EDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYILRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYILVIQATSAPLVSRATVHVRLLDRNDNPPVLGNFEILFNNYVTNRSSSFPGGAIGRVPAHDPDISDSLTYSFERGNELSLVLLNASTGELRLSRALDNNRPLEAIMSVLVSDGVHSVTAQCSLRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGHCRSREGGYTCLCRDGYTGEHCEVSARSGRCTPGVCKNGGTCVNLLVGGFKCDCPSGDFEKPFCQVTTRSFPARSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVSVDGCDTGVALRFGAMLGNYSCAAQGTQGGSKKSLDLTGPLLLGGVPDLPESFPVRMRHFVGCMKNLQVDSRHVDMADFIANNGTVPGCPTKKNVCDSNTCHNGGTCVNQWDAFSCECPLGFGGKSCAQEMANPQRFLGSSLVAWHGLSLPISQPWHLSLMFRTRQADGVLLQAVTRGRSTITLQLRAGHVVLSVEGTGLQASSLRLEPGRANDGDWHHAQLSLGASGGPGHAILSFDYGQQKAEGNLGPRLHGLHLSNMTVGGVPGPASSVARGFRGCLQGVRVSETPEGVSSLDPSRGESINVEPGCSWPDPCDSNPCPTNSYCSNDWDSYSCSCDPGYYGDNCTNVCDLNPCEHQSACTRKPSAPHGYICECLPNYLGPYCETRIDQPCPRGWWGHPTCGPCNCDVSKGFDPDCNKTSGECHCKENHYRPPSSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSVTFSELKGFAERLQRNESGLDSGRSQRLALLLRNATQHTSGYFGSDVKVAYQLATRLLAHESAQRGFGLSATQDVHFTENLLRVGSALLDAANKRHWELIQQTEGGTAWLLQHYEAYASALAQNMRHTYLSPFTIVTPNIVISVVRLDKGNFAGTKLPRYEALRGERPPDLETTVILPESVFREMPPMVRSAGPGEAQETEELARRQRRHPELSQGEAVASVIIYHTLAGLLPHNYDPDKRSLRVPKRPVINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALMITFLFLTLLRALRSNQHGIRRNLTAALGLAQLVFLLGINQADLPFACTVIAILLHFLYLCTFSWALLEALHLYRALTEVRDVNASPMRFYYMLGWGVPAFITGLAVGLDPEGYGNPDFCWLSIYDTLIWSFAGPVAFAVSMSVFLYILSARASCAAQRQGFEKKGPVSGLRSSFTVLLLLSATWLLALLSVNSDTLLFHYLFAACNCVQGPFIFLSYVVLSKEVRKALKFACSRKPSPDPALTTKSTLTSSYNCPSPYADGRLYQPYGDSAGSLHSASRSGKSQPSYIPFLLREESTLNPGQVPPGLGDPSGLFMEGQAQQHDPDTDSDSDLSLEDDQSGSYASTHSSDSEEEEEEAAFPGEQGWDSLLGPGAERLPLHSTPKDGGPGSGKVPWPGDFGTTTKENSGSGPLEERPRENGDALTREGSLGPLPGPSTQPHKGILKKKCLPTISEKSSLLRLPLEQGTGSSRGSTASEGSRNGPPPRPPPRQSLQEQLNGVMPIAMSIKAGTVDEDSSGSEFLFFNFLH

SEQ ID NO: 480 - protein, 3000 aa, Macaca mulatta
MAPPPPVLPMLLLLAAAAALPALGLRAAAWEAHVPGGARAFALGPGCTYAVGAARTSWAPRELLDVGRDGRLAGRRRVSGAGPRVRLAARGAPTALSRRLRARAHHPGCGARARLCGAFCFPVPGGGAAARLSALAAPTTLPACSCPPRPGPRCPGRPICLPPGSSVRLRLLCALWRAAGSVRVRLEVEAATAGTPSASPSPSPPLPPNLPQARVGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPVNANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASAFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNNFPTGVIGRIPAHDPDVSDSLNYTFLQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSNPCGANGRCRSREGGYTCECFQDFTGEHCEVDARSGRCANGVCKNGGTCVNLLIGGFHCVCPPGEYERPYCEVTTRSFPPRSFVTFRGLRQRFHFTVSLTFATQERNGLLLYNGRFNEKHDFIALEIVDEQVQLTFSAGETTTTVAPKVPGGVSDGRWHSVQVQYYNKPNIGHLGLPHGPSGEKMAVVTVDDCDTTMAVRFGKDVGNYSCAAQGTQTGSKKSLDLTGPLLLGGVPNLPEDFPVHNRQFVGCMRNLSVDGKNVDMAGFIANNGTREGCAARRNFCDGRRCQNGGTCVNRWNMYLCECPLRFGGKNCEQAMPHPQLFSGESVVSWSDLNVIISVPWYLGLMFRTRKEDSVLMEATSGGPTSFRLQILNNYLQFEVSHGPSDVESVMLSRLRVTDGEWHHLLIELKNVKEDSEMKHLVTMTLDYGMDQNRADIGGMLPGLTIRSVVVGGASEDKVSVRRGFRGCMQGVRMGGTPTNVATLNMNNALKVRVKDGCDVEDPCTSSPCPPHSRCHDTWEDYSCICDKGYLGINCVDACHLNPCENMGACVRSPGSPQGYVCECGPSHYGPYCENKLDLPCPRGWWGNPVCGPCHCAVSKGFDPDCNKTNGQCQCKENYYKPPAQDTCLPCDCFPHGSHSRTCDMATGQCACKPGVIGRQCNRCDNPFAEVTTFGCEVIYNGCPKAFEAGIWWPQTKFGQPAAVPCPKGSVGNAVRHCSGEKGWLPPELFNCTTISFVDLRAMNEKLSRNETQVDGAGALRLVRALRNATQHTGTLFGNDVRTAYQLLGRVLQHESWQQGFDLAATQDANFHEDVIRSGSALLAPATRAAWEQIQRSEGGTAQLLQRLEGYFSNVARNVRRTYLRPFVIVTANMILAVDIFDKFNFTGARVPQFDAIGEEFPRELESSVSFPADFFKPPEEKEGPLVRPAGRRTSPQSPRPEPGTEKEAPISRRRRHPDDAGQFAVALVIIYRTLGQLLPERYDPDRRSLRLPHRPVINTPMVSALVYSEGAPLPRPLERPVLVEFALLEVEERTKPVCVFWNHSLAVSGTGGWSARGCELLSRNRTHVACQCSHTASFAVLMDISRRENGEVLPLKIVTYATMSLSLAALLVAFVLLSLVRTLRSNLHSIHKHLAAALFLSQLVFVIGINQTENPFLCTVVAILLHYIYMSTFAWTLVESLHVYRMLTEARNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNLDALSFHYLFAIFSGLQGPFVLLFHCVLNQEVRKHLKGVLGGRKLHLEDSTTTRATLLTRSLNCNTTFGDGPDMLRTDLGESTASLDSTVRDEGVQKLSVSSGLVRGSHGEPDASFVPRTSKDPPGHDSDSDSELSLDEQSSSYASSHSSDSEDDGVGAEEKWDPTRGAIHSTPKGDAVANHILATWPDQSLAESDSEDPGGQPRLKVETKVSVELHREEQGSHRGENPPDRESGGTARPASCQPPEQRKGILKNKVTYPPPLMLTEQTLKGRLREKLADCEQSPTSSCTSSLGSGGPDCAITVKNPGREPGREHLNGVAMNVRTGSVQADGSDSE

SEQ ID NO: 481 - protein, 2741 aa, Rattus norvegicus
MEALFDERSNGYFLIDATTGAVTTARALDRETKDTHVLKVSAVDHGSPRRSAATYLTVTVSDTNDHSPVFEQSEYRERIRENLEVGYEVLTIRATDGDAPSNANMRYRLLEGAGGVFEIDARSGVVRTRAVVDREEAAEYQLLVEANDQGRNPGPLSASATVHIVVEDENDNYPQFSEKRYVVQVPEDVAVNTPVLRVQATDRDQGQNAAIHYSIVSGNLKGQFYLHSLSGSLDVINPLDFEAIREYTLRIKAQDGGRPPLINSSGLVSVQVLDVNDNAPIFVSSPFQAAVLENVPLGHSVLHIQAVDADAGENARLQYRLVDTASTILGGSSIDSENPVSAPDFPFQIHNSSGWITVCAELDRELLEHYSFGVEAVDHGSPPMSSSASVSITVLDVNDNDPVFTQPVYELRLNEDAAVGSSVLTLRARDRDANSVITYQLTGGNTRNRFALSSQSGGGLITLALPLDYKQERQYVLAVTASDGTRSHTAQVFINVTDANTHRPVFQSSHYTVSVSEDRPVGTSIATISATDEDTGENARITYVLEDPVPQFRIDPDTGTIYTMTELDYEDQAAYTLAITAQDNGIPQKSDTTSLEILILDANDNAPRFLRDFYQGSVFEDAPPSTSVLQVSATDRDSGPNGRLLYTFQGGDDGDGDFYIEPTSGVIRTQRRLDRENVAVYNLWALAVDRGNPNPLSASVEVQVTVLDINDNPPVFEKDELELFVEENSPVGSVVARIRANDPDEGPNAQIMYQIVEGNVPEVFQLDLLSGDLRALVELDFEVRRDYMLVVQATSAPLVSRATVHIRLLDQNDNPPELPDFQILFNNYVTNKSNSFPSGVIGRIPAHDPDLSDSLNYTFLQGNELSLLLLDPATGELQLSRDLDNNRPLEALMEVSVSDGVHSVTALCTLRVTIITDDMLTNSITVRLENMSQERFLSPLLSLFVEGVATVLSTTKDDIFVFNIQNDTDVSSNILNVTFSALLPGGARGRFFPSEDLQEQIYLNRTLLTTISAQRVLPFDDNICLREPCENYMKCVSVLRFDSSAPFISSTTVLFRPIHPITGLRCRCPPGFTGDYCETEIDLCYSNPCGANGRCRSREGGYTCECFEDFTGEHCQVNVRSGRCASGVCKNGGTCVNLLIGGFHCVCPPGEYEHPYCEVSTRSFPPQSFVTFRGLRQRFHFTVSLAFATQDRNALLLYNGRFNEKHDFIALEIVEEQLQLTFSAGETTTTVTPQVPGGVSDGRWHSVLVQYYNKPNIGHLGLPHGPSGEKVAVVTVDDCDAAVAVHFGSYVGNYSCAAQGTQSGSKKSLDLTGPLLLGGVPNLPEDFPVHSRQFVGCMRNLSIDGRIVDMAAFIANNGTRAGCASQRNFCDGTLCQNGGTCVNRWNTYLCECPLRFGGKNCEQAMPHPQRFTGESIVSWSDLDITISVPWYLGLMFRTRKEDGVLMEATAGTSSKLHLQILNSYIRFEVSHGPSDVASMQLSKTRVTDGGWHHLLIELRSAKEGKDIKYLAIMTLDYGMDQSTVQIGNQLPGLKMRTIVIGGVSEDKVSVRHGFRGCMQGVRVGETSTNIATLNMNDALKVRVKDGCDVEDPCASSPCPPHSHCRDTWDSYSCICDRGYFGKKCVDACLLNPCKHVAACVRSPNTPRGYSCECGPGHYGQYCENKVDLPCPKGWWGNPVCGPCHCAVSQGFDPDCNKTNGQCQCKENYYKPPAQDACLPCDCFPHGSHSRACDMDTGQCACKPGVIGRQCNRCDNPFAEVTSLGCEVIYNGCPRAFEAGIWWPQTKFGQPAAVPCPKGSVGNAVRHCSGEKGWLPPELFNCTSGFFVDLKAMNEKLSRNETRMDGNRSLRLAKALRNATQRNSTLFGNDVRTAYQLLARILQHESQQQGFDLAATREANFHEDVVHTGSSLLAPDTEAAWEQIQRSEAGAAQLLRHFEAYFSNVARNVKRTYLRPFIIVTDNMILAVDIFDKLNFTGAQVPRFQDVQEEFPRELESSVSFPADTFKPPEKKEGPMVRLTNRRTAPLTAQPEPRTERETSFSRQRRHPDEPGQFAVALVVIYRTLGQLLPEHYDPDHRSLRLPNRPVINTPVVNAMVYSEGTPFPSSLQRPVLVEFSLLETEERSKPVCVFWNHSLDIGGTGGWSAKGCELLSRNRTHVTCQCSHSASCAVLMDISRREHGEVLPLKIITYAALSLSLVALLVSFVLLSLVRTLRSNLHSIHKNLIAALFFSQLVFLVGINQTENPFLCTVVAILLHYVSMGTFAWTLVENLHVYRMLTEVRNIDTGPMRFYHVVGWGIPAIVTGLAVGLDPQGYGNPDFCWLSLQDTLIWSFAGPVGTVVIINTVIFVLSAKVSCQRKHHYYERKGVVSMLRTAFLLLLLVTATWLLGLLAVNSDTLIFHYLFAAFSCLQGIFVLLFHCVTHREVRKHLRAVLAGKKLHLDDSATTRATLLTRSLNCNNTYSEGPDMLRTGLGESTASLDSTTRDEGVQKLSVSSGPARGNHGEPDSSFIPRNSKKAHGPDSDSDSELSLDEHSSSYASSHTSDSEDDGGEAEDKWNPAGGPAHSTPKADALANHVPAGWPEESLAGSDSEELDTEPHLKVETKVSVELHRQAQGNHYGDRASDLESGVLAKPVAVLSSQPQEQRKGILKNKVTYPPPLPEQPLKCRLREKLADCEQSPTSSRTSSLGSGDGVHATDCVITIKTPRREPGREHLNGVAMNVCTGSAQADGSDSEGSNETSI

SEQ ID NO: 482 - protein, 2725 aa, Canis lupus familiaris
PQSTPELGSPPLPPTLPWAGQGRGARRARRGAGGSTAPQFPLPSYQVSVPENEPAGTAVIELRAHDPDEGEAGRLSYQMEALFDERSNGYFLIDAATGAVSTARALDRETKDTHVLKVSALDHGWPRRSAATYLTVTVSDTNDHSPAFEQSEYRERVRENLEVGYEVLTIRATDGDAPSNANMRYRLLEGAEGVFEIDARSGVVRTRAPVDREEAAAYQLLVEANDQGRNPGPLSATATVHIVVEDENDNYPQFGEKRYVVQVPEDVAVNTPVLRVRATDRDQGQNAAIHYSIVSGNLKGQFYLHSLSGSLDVINPLDFEAVREYTLRIKAQDGGRPPLINSSGLVLVQVLDVNDNAPIFVSSPFQAAVLENVPLGHSVLHIQAVDADAGENARLRYRLVDTASSSLGSGGPGTEDPGSPPDFPFQIHNSSGWITVCAELDREEIEHYSFGVEAVDHGSPPMSSSASVSITVLDVNDNDPVFTQPVYELRLNEDAAVGSSVLTLRARDRDANSVITYQLTGGNTRNRFALSSQSGGGLITLALPLDYKQERQYVLAVTASDGTRSHTAQVFINVTDANTHRPVFQSSHYTVSVSEDRPVGTSIATISATDEDTGENARITYVLEDPVPQFRIDPDTGTIYTMTELDYEDQAAYTLAITARDNGIPQKSDTTSLEILILDANDNAPRFLRDFYQGSVFEDAPPSTSVLQVSATDRDSGPNGRLLYTFQGGDDGDGDFYIEPTSGVIRTQRRLDRENVAVYNLRALAVDRGSPAPLSASVEIQVSVLDINDNPPVFERDELELFVEENSPVGSVVAKIRANDPDEGPNAQIMYQIVEGNVPEVFQLDLLSGDLRALAELDFEVRREYVLVVQATSAPLVSRATVHIRLLDQNDNPPVLPDFQILFNNYVTNKSNSFPTGVIGRIPAHDPDLSDSLNYTFLQGNELQLLLLDPATGELQLSRDLDNNRPLEALMEVSVSDGIHSVAALCTLRVTIITDDMLTNSITVRLENMSQEKFLSPLLSLFVEGVATVLSTTKDDVFVFNIQNDTDVSSNILNVTFSALLPGGVRDKFFPSEDLQEQIYLNRTLLTAVSTQRVLPFDDNICLREPCENYMKCVSVLKFDSSAPFISSTTVLFRPIHPITGLRCRCPPGFTGDYCETEIDLCYSSPCGAHGRCHSREGGYTCECLEDFTGEHCEVSTRSGRCANGVCKNGGTCVNLLIGGFHCVCPPGEFERPYCEVTTRSFPPRSFVTFRGLRQRFHFTVSLTFATQERNALLLYNGRFNEKHDFIALEIVSEQVQLTFSAGETTTTVTPQVPGGVSDGRWHSVQVQYYNKPNIGRLGLPHGPSGEKVAVVTVDDCDTAVAVRFGSLVGNYSCAAQGTQSGSKKSLDLTGPLLLGGVPNLPEDFPVHNRQFVGCMRNLSVDGKNVDMASFIANNGTRAGCAAQRNFCDGTWCQNGGTCVSRWNMYLCECPLRFGGKNCEQVMPHPQRFSGESIVSWSDLDITISVPWYLGLMFRTRKEDGVLMEATAGVSSRLHLQILNNYVQFEVFHGPSDVASMSLSRSRVTDGEWHHLLIELKSAKEGKDIKYLAVMTLDYGLDQDTVQIGNQLPGLKMRSIVVGGVSEDKVTVHRGFRGCMQGVRMGETSTNIAMLNMNDALKVRVKDGCDVEDPCTSSPCPQHSRCHNAWDGYSCVCDKGYFGRKCVDVCHLNPCQHVSACVHKPGSPRGYVCECGSSHHGQYCQNKIDLPCPKGWWGNPVCGPCHCAVSKGFDPDCNKTNGQCQCKENYYRPPDQDACLPCDCFPHGSHSRACDMDTGQCVCKSGVIGRQCNRCDNPFAEVTTLGCEVIYNGCPRAFEAGIWWPQTKFGQPAAVPCPKGSVGNAVRHCSGEKGWLPAELFNCTTVSFLELKAMNEKLSRNETRIDGDGSLRLAKALRNATQHTAALFGNDVRTAYQLLARVLLHESGQQGFELAATRDADFHQDVVRTGSALLAPDTQAAWEQIQRSEGGAVQLLRGFEAYFGNMVRNVRRTYLRPFVIVTANMILAVDIFDTFNFTGARVPRFEDIRDEFPKELESSVFFSADFFKPPESKESPTVRPAARKAAPQTAPPGPGAHREAPFRRQKRHPDEPGRFAVALVIIYRTLGQLLPERYDPDRRSLRLPNRPVINTPVVSAVVYSEGAPLPSPLERPVLVEHVLLETEERTKPVCVFWNHSITIGGAGGWSAKGCELLSRNRTHVACRCSHTTSFAVLMDVSRREHGEVLPLKIVTYAAVSLSLAALLVAFVLLALLRTLRSNLHSIHKNLIGALFFSQLVFVIGITQTGNPFLCTVIAIGLHYVYMSTFAWTFVESLHVYRMLTEVRNIDAGPMRFYYVVGWGIPAIITGLAVGLDPQGYGNPDFCWLSLRDTLIWSFVGPVGTVIIVNTVIFVLSAKVSCQRKHHYYERKGVVSLLRTAFLLLLLVAATWLLGLLAVNSDALAFHYLFAVCSCLQGLFVLLFHCVLNREVRKHLKGALAGKKLHPDDSATTRATLLTRSLNCNHSYSEEPNMFRTALGESTASLDSTVRDEGAQKLSVSSGPARGGHGEPDSSFVPRTTKRHHGHDSDSDSELSLDEQSSSYASSHSSDSEDDGVEAEDKWDSARGPVHSTPKVDATANHVPAGWPDESLAGSDSEEPGDQPRLKVETKVSVELHLDEQGNHCGERPPDQGSSGPPRPSGVLPSQPPEQRKG

SEQ ID NO: 483 - protein, 2903 aa, Cavia porcellus
PLPVRVLLANWGAPTAMSPHPRLGARQRRRLGPGIGGASRSPATQGAASSVHSALAPLALDPARRCPPPGGPVRLRLRCAVRRSPDSVPGELQLDPPSGTLPPILLRARSRVSRRARRGAGGSTNPQFPLPSYQVSVPENQPAGTTVIELVAHDPDEGEAGRLSYQMEALFDERSNGYFLIDGATGTVSTARELDRETKDTHVLKVSAVDHGSPRRSAATYLTVTVSDTNDHSPVFEQSEYRERVRENLEVGYEVLTIRATDGDAPSNANMRYRLLEGSGGVFEIDARSGVVRTRAVVDREEQAEYQLLVEANDQGRNPGPLSATATVHILVEDENDNYPQFSEKRYVVQVPEDLAVNTPVLRVQATDRDQGQNAAIHYSIVSGNLKGQFYLHSLSGSLDVINPLDFEAIREYTLRIKAQDGGRPPLINSSGLVSVQVLDVNDNAPIFVSSPFQATVLENVPLGHSVLHIQAVDADSGENARLSYRLVDTGSAAVGVGSAGPEDPDSTPDFPFQIHNSSGWITVCAELDREAVEHYSFGVEAVDHGSPPMSSSASVSITVLDVNDNDPVFTQPLYELRLNEDAAVGSSVLTLRARDRDANSVITYQLTGGNTRNRFALSSQSGGGLITLALPLDYKQERQYVLAVTASDGTRSHTVQVFINVTDANTHRPVFQSSHYTVSVSEDRPVGTPIATISATDEDTGENARITYVLEDPVPQFRIDPDTGTIYTMTELDYEDQAAYTLAITARDNGIPQKSDTTSLEILILDANDNAPRFLRDFYQGSVFEDAPPSTSVLQVSATDRDSGPNGRLLYTFQGGDDGDGDFYIEPTSGVIRTQRRLDRENVAVYNLRALAVDRGIPAALSASVDIQVTVLDINDNPPVFERDELELFVEENSPVGSVVAKIHANDPDEGPNAQIMYQIVEGNVPEVFQLDLLSGDLRALAELDFEVRRDYMLVVQATSAPLVSRATVRIHLLDQNDNPPELPDFQILFNNYVTNKSNSFPSGVIGRIPAHDPDLSDSLNYTFLRGNELHLLLLDSATGELQLSRDLDNNRPLEALMEVSVSDGIHSVSALCTLRVTIITDDMLTNSITVRLENMSQEKFLSPLLSLFVEGVATVLSTTKDDVFVFNIQNDTDVSSNILNVTFSALLPGGVRGRFFPSEDLQEHIYLNRTLLTAISAQRVLPFDDNICLREPCENYMKCVSVLRFDSSAPFISSASVLFRPIHPITGLRCRCPPGFTGDYCETEIDLCYSSPCSPNGRCRSREGGYSCECLEDFTGEHCQVNARSGRCANGVCKNGGTCVNLLIGGFHCLCPPGQFERPFCEVSTRSFPPESFVTFRGLRQRFHFTVSLQFATQEPNALLLYNGRFNEKHDFIALEVVGEQVQLTFSAGETTTTVTPQVPGGVSDGRWHSVQVQYYNKPNIGRLGLPHGPSGEKVAVVTVDDCDTAVAVHFGSYVGNYSCAAQGTQSGSKKSLDLTGPLLLGGVPNLPEDFPVRNRQFVGCMRNLSIDGQSVDMAGFIANNGTRAGCAAQRNFCEAAVCQHGGTCVNRWSTYLCHCPLHFGGKNCEQVMPHPQRFSGESLVSWSDLDITISVPWYLGLMFRTRKEDGVLLEATAGTLSRLHLQILNSYVQFEVSHGPSDVASMQLSRSRVTDGEWHHLLIELRSAKEGKDIKYLVVMTLDYGVDQNTVQIGNQLPGLKMRSVVIGGLSEDKVSVRRGFRGCMQGVRMGETSTNIATLSMKDALKVRVKDGCDTEDPCASSPCPQHSRCRDTWDGYACDCDRGFFGRRCVDACQVNPCKHLATCEHAPSSPRGYVCKCEAGHYGQYCENRIDLPCPKGWWGNPVCGPCHCAVSQGFDPDCNKTNGQCQCKENYYKPPAQDACLPCDCFPHGAHNRACDMDTGQCACKPGVIGRQCNRCDNPFAEVTSLGCEVIYNGCPRAFEAGIWWPQTKFGQPAAVPCPKGSVGNAIRHCSGEKGWLPPDLFNCTSSSFMGLKVTNEKLGRNESRLDTDQALRLVKALRNATRLGGALFGSEVRTAYQLLARVLQHESRQQGFDLAATRDADFHEDVVHTGSALLAPDTRAAWEQIQRGEAGVAQLLRHFEAYFSNVAHNLRRTYLRPFVLVTANMILAVDVFDKFNFTGARVPRFEDIKDDFPRELESSVSFPADVFKPLEKKALHQGPLKVADGLRRAMPHMTRSSPGAQTEAPVGRHRRHPDGPGQFAVALVIVYRTLGQLLPEHYDPDRRSLRLPSRPVINTPVVSTLVHSEGALRAGSLERPVLLEFTLLETEERSKPVCVFWNHSLDIGGTGGGWSAKGCELVSRNRTHVTCQCSHVTSCAVLMDVSRREHGEVLPLKIITYASIVLSLAALLVAFILLTLARTLRSNLHSIHRNLTAALFASQLVFVVGISQTENPFLCTVVAILLHHTYMGTFAWTLVEGLHVYRMLTEVRNIDAGPMRFYYVVGWGIPAIVTGLAVGLDPQGYGNPDFCWLSLHDSLIWSLAGPIGAVILINTVIFVLSVKVSCQRKHHYYERKGVRGSHRVAMGLETALVETGLWGTKRVNSDVLAFHYLFAAFSCVQGLFVLLSHCVLNREVRKHLRALLAGKKLHLDDSATTRATLLTRSLNCNNTYSEGPDMLRTALGESTASLDSTTRDEGVQKLSVSSGPARGDHREPPDPSYVPRDSKKPPGPDSDSDSEMSLDEHSSSYASSHSSDSEDDVRDAEDKWDSARGPVHSTPKANALANHTPAGWPEESLAGSDSEDPGPEPPLRVETKVSVELHRQEQANHCSSCPSDPAKPAAALGTQLPEQRKGILKNKVTYPPPLPDQPLKCRLREKLADCEQSPASSRTSSLGSGDGIHAPDCVITIKTARREPGREHLNGVAMNVCVGSAQAEGSDSEKP

SEQ ID NO: 484 - protein, 2777 aa, Felis catus
FPLPSYQVSVPENEPAGTGVIELRAHDPDEGEAGRLSYQMEALFDERSNGYFLIDPATGAVSTARALDRETKDTHVLKVSAVDHGSPRRSAATYLTVTVSDTNDHSPVFEQSEYRERVRENLEVGYEVLTIRATDGDAPSNANMRYRLLEGAGGVFEIDPRSGVVRTRAAVDREEAAAYQLLVEANDQGRNPGPLSATATVHIVVEDENDNYPQFSEKRYVVQVPEDVAVNTPVLRVQASDRDQGQNAAIHYSIVSGNLKGQFYLHSLSGSLDVINPLDFEAIREYTLRIKAQDGGRPPLINSSGLVLVQVLDVNDNAPIFVSSPFQAAVLENVPLGHSVLHIQAVDADAGENARLRYRLVDTASASAGGGAGPGPQDPAVPADFPFQIHNSSGWITVCAELDREEVEHYRFGVEAVDHGSPSMSSSASVSITVLDVNDNDPMFTQPVYELRLNEDAAVGSSVLTLRARDRDANSVITYQLTGGNTRNRFALSSQSGGGLITLALPLDYKQERQYVLAVAASDGTRSHTAQVFINVTDANTHRPVFQSSHYTVSVSEDRPVGTSVAVIGATDEDTGENARITYVLEDPVPQFRIDPDTGTVYTMTELDYEDQAAYTLAITARDNGIPQKSDTTSLEILILDANDNAPRFLRDFYQGSVFEDVPPSTSVLQVSATDRDSGPNGRLLYTFQGGDDGDGDFYIEPTSGVIRTQRRLDRENVAVYNLRALAVDRGSPAPLSASVEVQVSVLDINDNPPVFERDELELFVEENSPVGSVVARIRANDPDEGPNAQIMYQIVEGNVPEVFQLDLLSGDLRALVELDFEVRREYVLVVQATSAPLVSRATVHIRLLDQNDNPPVLPDFHILFNNYVTNKSNSFPTGVIGRIPAHDPDLSDSLNYTFLQGNELRLLLLDPATGELQLSRDLDNNRPLEALMEVSVSAHLHSVRALCTLRVTIITDDMLTNSITVRLENMSQEKFLSPLLSLFVEGVATVLSTTKDDVFVFNIQNDTDVSSNILNVTFSALLPGGVRDKFFPSEDLQEQIYLNRTLLTAVSAQRVLPFDDNICLREPCENYMKCVSVLKFDSSAPFISSTTVLFRPIHPINGLRCRCPPGFTGDSCETEIDLCYSSPCGTHGRCRSREGGYTCECLQDFTGEHCEVNSRSGRCANGVCKNGGTCVNLLIGGFHCVCPPGEFERPYCEVTTRSFPPRSFVTFRGLRQRFHFTVSLAFATQERNALLLYNGRFNEKHDFIALEIVGEQVQLTFSAGEATTTVTPQVPGGVSDGRWHSVQVQYYNKPNIGRLGLPHGPSGEKVAVVTVDDCDTAVAVRFGGLVGNYSCAAQGTQSGSKKSLDLTGPLLLGGVPNLPEDFPVHNRQFVGCMRNLSVDGKNVDMASFIANNGTRAGCDAQRNFCDRTWCQNGGTCVSRWNTYVCECPLRFGGKNCEQVMPHPQRFSGESVVSWSDLDITISVPWYLGLMFRTRKEDGVLMAATAGMASRLRLQILNNHVQFEVSHGPSDVASMRLSRSRVTDGEWHHLLIELKSAKEGKDIKYLAVMTLDYGMDQDTVQIGNQLPGLKMRSIVVGGVSEDKVSVHRGFRGCIQGVRMGETSTNIATLNMNDALKVRVKDGCDVEDPCSSSPCPPHSRCRDAWDAYSCICDKGYFGRKCVDVCHLNPCEHVSACVHSPSSPRGYVCECGSSHYGQYCENKIDLPCPKGWWGNPVCGPCHCAVGKGFDPDCNKTNGQCQCKENYYRPPDQDACLPCDCFPHGSHSRACDMDTGQCVCKSGVIGRQCNRCDNPFAEVTTLGCEVIYNGCPRAFEAGIWWPQTKFGQPAAVQCPKGSTGNAVRHCSGEKGWLPPDLFNCTTVSFVELKAMNEKLSRNETQMDGERSLWLARALRNATRHAGALFGNDVRTAYQLLGRVLLHESGRQGFELAATRDARFHEDVVRTGSALLAPDTQAAWEQIQRGEAGAVQLLKRFEAYFGNVARNVRRTYLRPFVVVTANMILAVDIFDTFNFTGARVPRFEDVRDEFPKELESSVFFSADFFRPPDRKEGPTVRPAGRKAAPQTAPPGPGTEREAPFRRRKRHPDEPGRFAVALVIIYRTLGQLLPEHYDPDRRSLRLPNRPVINTPVVSAVVYSEGAPLPSPLERPILVEHTLLETEERTKPVCVFWNHSITIGGTGGWSAKGCELLSRNRTHVVCQCSHTTSFAVLMDVSRREHGEVLPLKIVTYAAVSLSLTALLVAFVLLTLVRTLRSNLHGIHRNLIGALFFSQLVFVIGITQTGNPFLCTVIAIVLHYVYMSTFAWTVESLHVYHMLTEVRNIDAGPMRFYYVVGWGIPAIITGLAVGLDPQGYGNPDFCWLSLRDTLIWSFAGPIGTVIIVNTVIFVLSAKVACQRKHHYYERKGVVSLLRTAFLLLLLTSATWLLGLLAVNSDALTFHYLFAVFSCLQGLFVLLFHCVLNREVRKHLKGVLAGKKLHPDDSATTRATLLTRSLNCNHTYSEEPNMFRTALGESTTSLDSTMDEGGQKLSVSSGPARGGHGEPDSSFVPRSTKKPHGHDSDSDSELSLDEQSSSYASSRSSDSEDDGVEAEDKWDSARGPVHSTPKADTAANHIPAGWPNESLAGSDSEEPGDKPRLKVETKVSVELHLDEQGNHCSECPPDQESGGPPRPAGVPPNPPPEQRKVSAPTGILKNKVTYPPPLTEKSLKSRLREKLAECEQSPAPSRSSSLGSSYGARAPDGAITVKSPRREPGREHLNGVAMNVRAGSAQAAGSDSE

SEQ ID NO: 485 - protein, 2399 aa, Equus caballus
GRLSYQMEALFDERSNGYFLIDADTGAVSTARALDRETKDTHVLKVSAVDHGSARRSAATYLTVTVSDTNDHSPVFEQSEYRERVRENLEVGYEVLTIRATDGDAPSNANMRYRLLEGAGGVFEIDARSGVVRTRAAVDREEAAAYQLLVEANDQGRNPGPLSATATVHIVVEDENDNYPQFSEKRYVVQVPEDVAVNTPVLRVQATDGDQGQNAAIHYSIVSGNLKGQFYLHSLSGSLDVINPLDFEAIREYTLRIKAQDGGRPPLINSSGLVSVQVLDVNDNAPIFVSSPFQAAVLENVPLGHSVLHIQAVDADAGENARLRYRLVDTASASVGGGSAGLQDPASASDFPFQIHNSSGWITVCAELDREAVEHYSFGVEAVDHGSPPMSSSASVSITVLDVNDNDPMFTQPVYELRLNEDAAVGSSVLTLRARDRDANSVITYQLTGGNTRNRFALSSQSGGGLITLALPLDYKQERQYVLAVTASDGTRSHTAQVFINVTDANTHRPVFQSSHYTVSVSEDRPVGTSIATISATDEDTGENARITYVLEDPVPQFRIDPDTGTIYTMTELDYEDQAAYTLGITARDNGIPQKSDTTSLEILILDANDNAPRFLRDFYQGSVFEDAPPSTSVLQVSATDRDSGPNGRLLYTFQGGDDGDGDFYIEPTSGVIRTQRRLDRENVAVYNLRALAVDRGSPAPLSASVDIQVTVLDINDNPPVFERDELELFVEENSPVGSVVARIRANDPDEGPNAQIMYQIVEGNVPEVFQLDLLSGDLRALVELDFEVRREYVLVVQATSAPLVSRATVHICLLDQNDNPPVLPDFQILFNNYVTNKSNSFPTGVIGRIPAHDPDLSDSLNYTFLQGNELQLLLLDSATGELQLSRDLDNNRPLEALMEVSVSDGIHSVVALCTLRVTIITDDMLTNSITVRLENMSQEKFLSPLLSLFVEGVATVLSTTKDDVFVFNIQNDTDVSSNILNVTFSALLPGGVRGKFFPSEDLQEQIYLNRTLLTAVSTQRVLPFDDNICLREPCENYMKCVSVLKFDSSAPFISSTTVLFRPIHPINGLRCRCPPGFTGDYCETEIDLCYSSPCGANGRCRSREGGYTCECLEDFTGEHCEVNARSGRCANGVCKNGGTCVNLLIGGFHCVCPPGGFERPYCEVTTRSFPPQSFVTFRGLRQRFHFTISLTFATQERNALLLYNGRFNEKHDFIALEIVDEQVQLTFSAGETTTMVAPQVPGGVSDGRWHSVQVQYYNKPNIGRLGLPHGPSGEKVAVVTVDDCDTAVAVRFGSLVGNYSCAAQGTQSGSKKSLDLTGPLLLGGVPNLPEDFPVHNQQFVGCMRNLSIDGRNVDMAAFIANNGTRAGCVAQRNFCDGTWCQNGGTCVSRWNTYLCECPLRFGGKNCEQVMPHPQRFSGESIVSWSDLDITISVPWYLGLMFRTRKEDGVLMEATAGMSSRLHLQILNSHIQFEVSHGPSDVASMRLSRSRVTDGEWHHLLIELKSAKEGKDIKYLAVMTLDYGMDQDTMQIGNQLPGLRESLIVGGSEDKVSVPKGFRGCMQGVRMGETSTNIAMLNMNDALKVRVKDGCDMENPCASSPCPQHSRCQDSWDGYSCVCDKGYFGRKCVDVCHLNPCEHVAACVRSPGSPRGYVCECGSSHYGQYCENRIDLPCPKGWWGNPVCGPCHCAVSKGFDPDCNKTNGQCQCKENYYRPPDQDACLPCDCFPHGSHSRTCDADTGQCACKPGVIGRQCNRCDNPFAEVTTLGCKVIYSGCPRAFEAGIWWPQTKFGQPAAVPCPKGSVGNAVRHCSGEKGSLPPELFNCTTVSFVELKAMNEKLSRNETRMDGDGSLRLARALRNATRHTDVPFGNDVRTAYQLLGRVLQHESGQQGFDLAATRDANFHEDVIHTGSALLAPGTRAAWEHIQRSEGGAAQLLKHFEAYFRNVARSVRQTYLRPFVIVTANMILAVDVFDTFNFTGARVPRFQDVREDFPKELESSVVFSADFFKPTERKEGPTVRPVGRKAALQTVRPEPSAEREAQFRRRKRHPDEPGQFAVALVVIYRTLGQLLPEHYDPDRRSLRLPNRPVINTPVVSAVVYREGAPLTSPPERPILVEYTLLETEERTKPVCVFWNHSITISGTGGWSAKGCELLSRNRTHVSCQCSHATSCAVLMDVSRREHGEVLPLKIITYAAVSLSLAALLVAFVLLALVRPLRSNLHSIHKNLTGALFFSQLVFVIGITQTENPFLCTVIAILLHYVYMSTFAWSFVESLHVYRMLTEVRNIDAGPMRFYYVVGWGIPAIVTGLAVGLDPQGYGNPDFCWLSLQDTLIWSFAGPIGTVIIVNTVIFVLSAKVSCQRKHHYYERKGIVSLLRTAFLLLLLISATWLLGLLAVNSD

SEQ ID NO: 486 - protein, 2860 aa, Gorilla gorilla gorilla
ALCFPVPGGCAAAQHSALAAPTTLPACRCPPRPRPRCPGRPICPPPGGSVRLRLLCALRRAAGAVRVGLALEAATAGTPSASPSPSPPLPPNLPASGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASAFLGGGSAGPKNPAPTPDFPFQIHNSSGWITVCAELDREEVEHYSFGVEAVDHGSPAMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGIMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLSGDLRAMVELDFEVRREYVLVVQATSAPLVSRATVHILLVDQNDNPPMLPDFQILFNNYVTNKSNSFPSGVIGRIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCHSREGGYTCECFEDFTGEHCEVDARSGRCANGVCKNGGTCVNLLIGGFHCVCPPGEYERPYCEVTTRSFPPRSFVTFRGLRQRFHFTISLTFATQERNGLLLYNGRFNEKHDFIALEIVDEQVQLTFSAGETTTTVAPKVPSGVSDGRWHSVQVQYYNKPNIGHLGLPHGPSGEKMAVVTVDDCDTTMAVRFGKDIGNYSCAAQGTQTGSKKSLDLTGPLLLGGVPNLPEDFPVHNRQFVGCMRNLSVDGKNVDMAGFIANNGTQEGCAARRNFCDGRRCQNGGTCVNRWNMYLCECPLRFGGKNCEQAMPHPQLFSGESIVSWSDLNVIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTIRSMVVGGASEDKVSVRRGFRGCMQGVRMGGTPTNVATLNMNNALKVRVKDGCDVEDPCTSSPCPPNSRCHDAWEDYSCVCDKGYLGINCVDACHLNPCENMGACVRSPGSPQGYVCECGPSHYGPYCENKLDLPCPRGWWGNPVCGPCHCAVSKGFDPDCNKTNGQCQCKENYYKPPAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRNATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDAIHEEFPRELESSVSFPADFFKPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRTLRSNLHSIHKHLAAALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIVSQVVAMGAGLILPSRSSLLRTAFLLLLLISATWLLGLLAVNHDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLARGSHGEPDASLMPRSSKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSE

SEQ ID NO: 487 - protein, 2941 aa, Danio rerio
MKGDLLLFVFGCFELAGLVDCFSVHVSEDAGPGTAIAELQRGSCALDQLLLPRFAETFLRPDAGVLTLSNAPNCDSVLSNPFSVYAVVDCKDASGFRHLVTSRYDVHVHGKNCASTRKRENKLDVEIISLTESSECREAHSAVFRVFDVLPGNPARCNVTRTSAFYMSDGSLFTSARLCFTRDSLLEFQMRCGGRAGAAHAHWRVGRGPFTQTHLSKVLRLAARSNSGLLSRRRRNVNNNPQFHPPMYQVSVPENQPAGTFVVVLKAVDPDEGEAGRLEYVLEALFDSRSNNLFAVDPASGVVSTVEILDRETKDTHVFRVTAVDHGTPRRTAMATLTVTVSDTNDHDPAFEQQDYKESIRENLEIGYEVLTVRATDGDAPINGNILYHLLNSNGTNDVFEIDSRSGVIRTRGLVDRETVDSYMLMVEANDQGRDPGPRSATATVHIVVEDDNDNAPQFSEKRYIVQVPEDLTPNTEILQVTATDQDRGNNAVVHFSIMSGNTRGQFYIDAQTGKLDLVSQLDYEMNKEYTLRIRAQDGGRPPLSNISGLVTVQVLDINDNAPIFVSTPFQATVLENVPVGYSVIHIQAVDADAGDNSRLEYRLTETTANFPFTINNSTGWIVVAAELDRETVDFYNFGVEARDHGAPAMSSSASISMTILDVNDNNPEFTQKAYYMRLNEDAAVGTSVVTVSAVDQDINSVVTYQISSGNTRNRFSITSQSGGGLITLALPLDYKLERQYVLTVTASDGTRFDTAKVYVNVTDANTHRPVFQSSHYTVNINEDRPVGTTVVMISATDEDTGENARITYIMDDSIPQFNIDADSGAVTTQMELDYEDQVSYTLAITARDNGIPQKSDTTYLEILVNDVNDNSPVFQRDRYLGSVMEDIPVFTSVLQVSATDRDSGLNGRVFYTFQGGEDGDGDFIIESTSGIVRTLRRLDRENTAIYNLQAFAVDKGVPALKTAVDMQVTILDVNDNPPVFEKDEFDIFVEENSPIGLVVAHISASDPDEGSNAQIMYQIVEGNIPEVFQLDIFSGELTALTDLDYETRAEYVIVVQATSAPLVSRATVHIKLIDKNDNVPVLKNFQIIFNNYVTDKTNSFPSGVIGRIPAQDPDVSDQLHYSFEAGNELKLVILNQSTGEIRLSRALDNNRPLEASMKISVSDGVHSVSAQCLLQVTVITDEMLSNSITLRLANASQERFLSLLLAQFLEGVASVLSASREDVVVFNIQDDTDVSAGILNVSLSVALPGQGSRGRGVSQGSEVEFFGSEELQERLYLNRSLLAQISSQEVLPFDDNICLREPCENYMKCVSVLKFDSLAPFVASDTILFRPIHPIAGLRCRCPLGFTGDYCETEIDLCYSRPCGAHGVCRSHEGGYTCHCMQDYTGERCEISSRSGRCAEGVCKNGGTCLNLLVGGFRCECPSGGFEKPFCLLSSRNFPPQTFITFKGLRQRFHFTLSLSFATREPNGLLLYNGRFNEKHDFIAMEIVNQQIQLTFSAGGTKTTVLPFIEGGVSDGHWHTAHVHYYNKPVLNRAGLPQGPSDQKVVVVTVDDCDSSVALRFGHVVGNYSCSAQGSQLGSKKSLDLTGPLLLGGGVPKLPEEFPVQNRQFIGCMKDLRIDERHVDMAGFIANNGTLPGCSAKRNFCNNNPCLNGGSCVSLWGSFRCDCALGFGGRNCEKVMSNPLRLQGKGLLWWADLASVMTPPWHMEFMFRTRQPTATVMHMSSGQQHNFTIQLREGFVVTSVQRGEDSVVSRVDDVTVSDGQWHHVSLELKGPATGGVTATLSLDYGLYTSSMDLDSKLKGVRLKTLSVGGVSDGRNRVIGGFRGCIQGLRIGGDSSTPAFPSMPQARVLNVESGCSLPNTCGSNPCPAHSDCKDDWDAHSCRCHTGYYGNSCTDACALNPCEHQSACSRRSSSAHGYTCSCPSNYFGQYCEKKTDLPCPRGWWGEKSCGPCNCDTTKGFDADCNKTNGACRCKDNHFRPPSSDTCVLCDCYAVGSLSRVCDRAVGQCQCKPGVIGRQCDRCDNPFAEVSSSGCEVIYDSCPQAIEAGIWWPRTKFGLPAAVACPKGSIGTAIRHCDEHKGWLSANLFNCTSVSFSKLKTLSERLVRNASLMDSTNVQQTAALLFNATKNTREFYGSDVKIAFHLLRAILRHESQQQGFNLTATQDVLFNEHLMHVGSAILRAETRGHWQTIQQTESGTDTLLRQFEEYTHTLAQNMRRTYLNPFTIVTPSIVISIDRLEKMNFAGAKLPRYQSLRGPRPLDLETAVTLPDSVFSPAPEGKGHRHHSEPIIEPGRNHTANRKRRHPDERQEDAIASIIIFHTLATLLPERYDTDKRSLRVPKRPVINTPVVSITVHDNEELLQHTLDKPIIVQFRLVTTEERSKPICVFWNHSIVAASPGGWSSKGCEVVFRNSTHISCQCYHMTSFAVLMDISRRENGEILPVKLVTWSSVGATLFFLLLTIIFLSCLRAANSNKTSIAKNGSSALFIALLVFILGISQADNPFVCTLMAILLHFFWLCVFSWLFLEGLHVYRMLSELRDINYGPMRFYYLIGWGVPAFITGLAVGLDPEGYGNPDFCWLSLYDTLIWSFAGPIAFVVSMNLFLYIMASRASCSLRQKSCEKRDVPAAGLRTACTVLFLVTVTCLLALLSVNSDIILFHYLFAGFSCVQGVFIFFLRVVFNQEARDAMRYCCSGKRPDHMIKSKPAAFLCSSNYVDGGLYHLPFAESSVSLNGTHSSKTQQNYMPFSLRGNDMNSSHLSLSEQNTLFKDKEQMDDPDSDSDSDLSELEDDQSGSYASTHSSDSEEEEEGAFQEECWENLATSGSGKPLGVCEGEIRATDETVDKAEDHGTENLLLLLPSLPHTQPHKGILKKKQLSPIAERNAINRIHNQLSGDSASSRGPSSNEDRGGGARRNHVNGASVSGLMKTLDNDSSESEC

SEQ ID NO: 488 - protein, 3300 aa, Bos taurus
VMARRQPWWDLRGPTTPLLLLLSLLSLFPLSREELGDGGGHGWDPGVAAATGPGARIGNGALALCPEPPGVREDGEPGLGVREPVFVGLRGGRQSAQSGRGPPEQPGLGAEYGVKTFGSRGRETGQGPGSLLCWRPEVSSCRRIGPLRRDSLSPEGLSPGVPGPENNPPFPSDLLIRPRGSQPVSSRRNTGRGSSPKVGTTRCCGELWGPGRRGQSERTATSRARRTGPRSDRPPGAVGSGPGLDSAPRTARTAPESGSAPRESRTAPEPTPERMRSRGLFRRRFLPQRPGPRPPGAPARPGAWRIPLEGRARPRRAANRHPQFPQYNYQALVPENEAAGTAVLRVVAQDPDTGEAGRLVYSLAALMNSRSLELFSIDPQSGLIRTEAALDRESMDRHYLRVTAQDHGSPRLSATTMVAVTVADRNDHAPVFEQAQYRETLRENVEEGYPILQLRATDGDAPPNANLRYRFVGPPAARAAAADAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHTPIFVSTPFQVSVLENAPLGHSVIHIQAVDADHGENSRLEYSLTGVAPDTPFVINSATGWVSVSGPLDRESVEHYFFGVEARDHGSPPLSASASVTVTVLDVNDNRPEFTMKEYHLRLNEDATVGTSVVSVTAVDRDANSAISYQITGGNTRNRFAISTQGGVGLVTLALPLDYKQERYFKLVLTASDRALHDHCYVHINITDANTHRPVFQSAHYSVSDDVGENARITYLLEDNLPQFRIDTDSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVPVYELTAYAVDRGVPPLRTPVSIQVTVQDVNDNAPVFPAEEFEVRVKENSIVGSVVAQITAVDPDEGPNAHIMYQIVEGNIPELFQMDIFSGELTALIDLDYEARQEYIIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTADGLHSVTAQCVLRVVIITEELLANSLTVRLENMWQERFLSPLLGHFLEGVAAVLATPAEDVFIFNIQNDTDVGGTVLNVSFSALAPRGAGAGSTGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACSRREGGYTCVCRPRFTGEDCELDTEAGRCVPGVCRNGGTCANGPDGGFRCQCPAGGAFEGPRCEVAARSFPPSSFVMFRGLRQRFHLTLSLSFATVQPSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGTQTSSKKSLDLTGPLLLGGVPNLPENFPVSHKDFVGCMRDLHIDGRRVDMASFVANNGTVAGCQAKLHFCDSGPCKNNGICSERWGGFSCDCPVGFGGKDCRLTMAHPHHFRGNGTLSWDFGNDVAVSVPWYLGLAFRTRVKQGVLMQVQAGPHSTLLCQLDRGLLSVTVTRASGRAAHLLLDQMIVSDGRWHDLRLELQEEPGGRRGHHVLMVSLDFSLFQDTLAVGSELQGLKVKQLHVGGLPHGAEEEAPQGLVGCIQGVWFGSTPSGSPALLPPSHRVNVEPGCVVTNACASGPCPPHADCRDLWQTFSCTCWPGYYGPGCVDACLLNPCQNQGSCRHLPGAPHGYTCDCVGGYFGHHCEHRMDQQCPRGWWGSPTCGPCNCDVHKGFDPNCNKTDGQCHCKEFHYRPRGSDSCLPCDCYPVGSTSRSCAPHSGQCPCRPGALGRQCNSCDSPFAEVTASGCRVLYDACPKSLRSGVWWPQTKFGILASVPCPRGALGAAVRLCDEDRGWLEPDLFNCTSPAFRELNLLLDGLELNKTVLDTVEAKKLAQRLREVTGHTDHYFSQDVRVTARLLAHLLAFESRQQGFGLTATQDAHFNENLLWAGSALLAPETGDLWAALGQRAPGGSPGSAGLVQRLEEYAATLARNMELTYLNPVGLVTPNIMLSIDRMEHPSPTRGTRRYPRYHSNLFRGQDAWDPHTHVLLSSQAPRPSPAEVLYPSGSSMENATTSSMAPPPAPPEPEPEPGISIVILLVYRTLGGLLPAQFQAERRGARVPQNPVMNSPVVSVAVFHGRNFLRGVLESPISLEFRLLQTANRSKAICVQWDPPGPADQHGLWTARDCELVHRNGSHARCRCSRTGTFGVLMDASPRERLEGDLELLAVFTHVVMAVSVAALLLTAAVLLSLRSLKSNMRGIHANVAAALGVAELLFLLGIHRTQNQLLCTAVAILLHYFFLGTFAWLLVQGLHLYRMQVEPRNVDRGAMRFYHALGWGVPAVLLGLAVGLDPEGYGNPDFCWISIHDPLIWSFAGPVILVLVMNGTMFLLAARTSCSTGQREAKKTSVLTLRSSFLLLLLISASWLFGLLAVNHSILAFHYLHAGLCGLQGLVVLLLFCVLNSDTRAAWTPACLGRKAAPEEARPAPGTGPGAYNNTALFEESGLIRITLGASTVSSVSSARSGRTQDQDSQRGRSYLRDNVLVRHGSAADHTDHGLQAHAGPTDLDVAMFHRDAGGGADSDSDSDLSLEEERSLSIPSSESEDNGRTRGRFQRPLRRAAQSERLLTHPKDVDGNDLLSYWPALGECEAAPCALQTWGSERRLGLDTSKDAANNNQPDLALTSGDETSLGGAQRQRKGILKNRLQYPLVPQTRGAPELSWCRAATLGHRAVPAASYGRICAGGGTGSLSQPASRYSSREQLDLLLRRQLSRERLEEAPAPVLRPLSRPGSQECLDAVPGRPEPRDRGSTLPRRQPPRDHPGATAGRFGSRDALDRGAPCEWLRTLPPPRGARDLDPQPPPLPLSPQRQLSRDPLLPSRPLDSLSKRSNSGEPLDHAPSRHPSREGLGPPPQLLRVREAPASGPSHGPSTEQLDILSSILASFTSSALSSSVQSSGTPSGPHTTPTPSATASALGPSTPRSATSHSISELSPDSEVPRSEGHS

SEQ ID NO: 489 - protein, 3306 aa, Equus caballus
MARQPLWWSLRGPTTPLLLLLLLSLFPLSREELEDGGGQGWDPRIVAATGRGAQIGGGALALCPETPEIQEDGEPGLGIREPVFVGLRGGRQSTQSGRGPPEQPDPGLRAEYGVQALGSHGRETGQGTGSLLCWRPEISSCGKTGPLRRDSLSLEALSPGVPGPEDSSPFPSDLLVPPRGSKSVSSQRNAGRSALQKVGTIRCCGELWASGRRSQGEKRATSREERIVPRTDCPPGAAGSDPELVSAPLTARTAPASSSAPRKSRTAPEPAPERMRSRGLFRRRFLPQRPGPRPPGVPAEPGAWKTLPASRVRPRRAANRHPQFPQYNYQALVPENEAAGTVVLRVVAQDPDTGEAGRLVYSLAALMNSRSLELFSIDPQSGLIRTEAALDRESMERHYLRVTAQDHGSPRLSATTMVAVTVADRNDHAPVFEQAQYRETLRENVEEGYPILQLRATDGDATPNANLRYRFVGSPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHTPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDWPVGSTVVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVPVYELTAYAVDRGVPPLRTPVSIQVTVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVCLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGHFLEGVAAVLATPAEDVFIFNIQNDTDVGGTVLNVSFSALAPRGAGTGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDGPDGGFHCQCPAGGAFEGPRCEVAARSFPPSSFVMFRGLRQRFHLTLSISFATVQPSGLLFYNGRLNEKHDFLALELVAGQVRLTYSTGESNTVVSPTVPGGLSDGQWHTVHLRYYNKPRTDALGGAQGPSKDKVAVLSVDDCNVAVALQFGAEIGNYSCAAAGMQTSSKKSLDLTGPLLLGGVPNLPENFPVSHKDFVGCMRDLHIDGRRVDMAAFVANNGTTAGCQAKLHFCDSGPCKNSGFCSERWGGFSCDCPVGFGGRDCRLTMAYPHRFHGNGTLSWDFGNDMAVSVPWYLGLAFRTRATKGVLMQVQAGPHSTLLCQLDRGLLSVTMTRGSGRAAHLLLDQVAVSDGRWHDLRLELQEEPGGRRGHHVLMVSLDFSLFQDTMAVGSELQGLKVKRLHVGGLPPSSEEESPQGLVGCIQGVWLGSTPLGSPALLAPSHRVNVEPGCVVTNACASGPCPPHADCRDLWQTFSCTCWPGYYGPGCVDACLLNPCQNQGSCRHLPGAPHGYICDCVGGYFGHHCEHRMDQQCPRGWWGSPTCGPCNCDVHKGFDPNCNKTNGQCHCKEFHYRPRDSDSCLPCDCYPVGSTSRSCAPHSGQCPCRPGALGRQCNSCDSPFAEVTASGCRVLYDACPKSLRSGVWWPQTKFGVLASVPCPRGALGLRGAGAAVRLCDEDQGWLEPDLFNCTSPAFRELSLLLDGLELNKTALDTVEAKKLAQRLREVTSHTDHYFSQDIRVTARLLAHLLTFESHQQGFGLTATQDAHFNENLLWAGSALLAPETGDLWAALGQRAPGGSPGSAGLVQHLEEYAATLARNMELTYLNPVGLVTPNIMLSIDRMEHPSPTRGTRRYPRYHSNLFRGQDAWDPHTHVLLPSQAPRPSPSEVLSTSSSSIENSTTSSVAPPPAPPETEPEPGISIVILLVYRTLGGLLPAQFQAERRGARLPQNPVMNSPVVSVAVFHGRNFLRGVLESPISLEFRLLQTANRSKAICVQWDPPGPADQHGMWTARDCELVHRNGSHARCRCSRTGTFGVLMDASPRERLEGDLELLAVFTHVVVAVSVAALLLTAAILLSLRSLKSNMRGIHANVAAALGVAELLFLLGIHRTQNQLVCTAVAILLHYFFLSTFAWLLVQGLHLYRMQVEPRNVDRGAMRFYHALGWGVPAVLLGLTVGLDPEGYGNPDFCWISVYEPLIWSFAGPVVLVVVMNGTMFLLAARTSCSTGQREAKKSSVLTLRSSFLLLLLISASWLFGLLAINHSILAFYYLHAGLCGLQGLVVLLLFCVLNADARAAWTPACLGRKAVPEEARPAPGTGPGAYNNTALFEESGLIRITLGASTVSSVSSARSGRTQDQDSQPGRSYLRDNVLVRHGSAADHTDHSLQAHAGPTDLDVAMFHRDAGADSDSDSDLSLEEERSLSIPSSESEDNGRTRGRFQRPLRRAAQSERLLTHPKDVDGNDLLSYWPALGECEAAPCALQTWGSERRLGLDTSKDAANNNQPDLALTSGDETSLGRAQHQRKGMIPDLGLHLRDPGDCPFQSPNPKLLHRHPESSSCSNLGSFCSSTLLHDPWRLPLLYIPRLREFLPPPYTPCPLFVCLTGILKNRLQYPLMPQTRGPPELSWCRAATLGHCAVPAASYDHGNALDFRGTCEWLSTLPLPHSAQDLDHSPTSAPVSQRQLSRDPLLPSRPLDSLSRRSNSGERLDHGPSRHPSREGLGPPQLLRVREDPASGPSHGPSTEQLDILSSILASFNSSALSSSVQSSSTPSGPHTTATPSATASALGPSTPRSATSHSISELSPDSEVPRSEGRS

SEQ ID NO: 490 - protein, 3309 aa, Mus musculus
MARRPLWWGLPGPSTPVLLLLLLSLFPFSREELGGGGDQDWDPGVATTTGPRAQIGSGAVALCPESPGVWEDGDPGLGVREPVFMRLRVGRQNARNGRGAPEQPNAEVVVQALGSREQEAGQGPGYLLCWHPEISSCGRTGPLRRGSLPLDALSPGDSDLRNSSPHPSELLAQPDGSRPVAFQRNARRSIRKRVETSRCCGKLWEPGHKGQGERSATSTVERGPFRRDCLPGSLGSGLGEDSAPRAVRTAPTPGSAPRESRTAPGRMRSRGLFRRRFLFERPGPRPPGFPTGPEAKQILSTNQARPRRAANRHPQFPQYNYQTLVPENEAAGTSVLRVVAQDPDPGEAGRLIYSLAALMNSRSLELFSIDPQSGLIRTAAALDRESMERHYLRVTAQDHGSPRLSATTMVAVTVADRNDHAPVFEQAQYRETLRENVEEGYPILQLRATDGDAPPNANLRYRFVGSPAVRTAAAAAFEIDPRSGLISTSGRVDREHMESYELVVEASDQGQEPGPRSATVRVHITVLDENDNAPQFGEKRYVAQVREDVRPHTVVLRVTATDKDKDANGLVHYNIISGNSRGHFAIDSLTGEIQVMAPLDFEAEREYALRIRAQDAGRPPLSNNTGLASIQVVDINDHAPIFVSTPFQVSVLENAPLGHSVIHIQAVDADHGENSRLEYSLTGVASDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSMNEDRPVGSTVVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVPVYELTAYAVDRGVPPLRTPVSIQVTVQDVNDNAPVFPAEEFEVRVKENSIVGSVVAQITAVDPDDGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNRTSGELRLSRKLDNNRPLVASMLVTVTDGLHSVTAQCVLRVVIITEELLANSLTVRLENMWQERFLSPLLGHFLEGVAAVLATPTEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASTSTLFRPIQPIAGLRCRCPPGFTGDFCETELDLCYSNPCRNGGACARREGGYTCVCRPRFTGEDCELDTEAGRCVPGVCRNGGTCTNAPNGGFRCQCPAGGAFEGPRCEVAARSFPPSSFVMFRGLRQRFHLTLSLSFATVQPSGLLFYNGRLNEKHDFLALELVAGQVRLTYSTGESNTVVSPTVPGGLSDGQWHTVHLRYYNKPRTDALGGAQGPSKDKVAVLSVDDCNVAVALQFGAEIGNYSCAAAGVQTSSKKSLDLTGPLLLGGVPNLPENFPVSHKDFIGCMRDLHIDGRRMDMAAFVANNGTMAGCQAKSHFCASGPCKNNGFCSERWGGFSCDCPVGFGGKDCRLTMAHPYHFQGNGTLSWDFGNDMAVSVPWYLGLSFRTRATKGILMQVQLGPHSVLLCKLDRGLLSVTLNRASGHTVHLLLDQMTVSDGRWHDLRLELQEEPGGRRGHHIFMVSLDFTLFQDTMAMGGELQGLKVKQLHVGGLPPSSKEEGHQGLVGCIQGVWIGFTPFGSSALLPPSHRVNVEPGCTVTNPCASGPCPPHADCKDLWQTFSCTCRPGYYGPGCVDACLLNPCQNQGSCRHLQGAPHGYTCDCVSGYFGQHCEHRVDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGLRGTGAAVRLCDEDQGWLEPDLFNCTSPAFRELSLLLDGLELNKTALDTVEAKKLAQRLREVTGQTDHYFSQDVRVTARLLAYLLAFESHQQGFGLTATQDAHFNENLLWAGSALLAPETGHLWAALGQRAPGGSPGSAGLVQHLEEYAATLARNMELTYLNPVGLVTPNIMLSIDRMEHPSSTQGARRYPRYHSNLFRGQDAWDPHTHVLLPSQASQPSPSEVLPTSSNAENATASSVVSPPAPLEPESEPGISIVILLVYRALGGLLPAQFQAERRGARLPQNPVMNSPVVSVAVFHGRNFLRGVLVSPINLEFRLLQTANRSKAICVQWDPPGPTDQHGMWTARDCELVHRNGSHARCRCSRTGTFGVLMDASPRERLEGDLELLAVFTHVVVAVSVTALVLTAAVLLSLRSLKSNVRGIHANVAAALGVAELLFLLGIHRTHNQLLCTAVAILLHYFFLSTFAWLLVQGLHLYRMQVEPRNVDRGAMRFYHALGWGVPAVLLGLAVGLDPEGYGNPDFCWISIHEPLIWSFAGPIVLVIVMNGTMFLLAARTSCSTGQREAKKTSVLRTLRSSFLLLLLVSASWLFGLLAVNHSILAFHYLHAGLCGLQGLAVLLLFCVLNADARAAWTPACLGKKAAPEETRPAPGPGSGAYNNTALFEESGLIRITLGASTVSSVSSARSGRAQDQDSQRGRSYLRDNVLVRHGSTAEHTERSLQAHAGPTDLDVAMFHRDAGADSDSDSDLSLEEERSLSIPSSESEDNGRTRGRFQRPLRRAAQSERLLAHPKDVDGNDLLSYWPALGECEAAPCALQAWGSERRLGLDSNKDAANNNQPELALTSGDETSLGRAQRQRKGILKNRLQYPLVPQSRGTPELSWCRAATLGHRAVPAASYGRIYAGGGTGSLSQPASRYSSREQLDLLLRRQLSKERLEEVPVPAPVLHPLSRPGSQERLDTAPARLEARDRGSTLPRRQPPRDYPGTMAGRFGSRDALDLGAPREWLSTLPPPRRNRDLDPQHPPLPLSPQRQLSRDPLLPSRPLDSLSRISNSREGLDQVPSRHPSREALGPAPQLLRAREDPASGPSHGPSTEQLDILSSILASFNSSALSSVQSSSTPSGPHTTATASALGPSTPRSATSHSISELSPDSEVPRSEGHS

SEQ ID NO: 491 - protein, 740 aa, Artificial Sequence
  synthetic polypeptide sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPSQLHLMYVAAAAFVLLFFVGCGVLLSRKRRRQHGQLWFPEGFKVSEASKKKRREPLGMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

SEQ ID NO: 492 - protein, 710 aa, Artificial Sequence
  synthetic polypeptide sequence
MALPVTALLLPLALLLHAARPEQKLISEEDLDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSPGIAGISSPGPKRKSMVLDVVFVLEGSDEVGEANFNKSKEFVEEVIQRMDVSPDATRISVLQYSYTVTMEYAFNGAQSKEEVLRHVREIRYQGGNRTNTGQALQYLSEHSFSPSQGDRVEAPNLVYMVTGNPASDEIKRLPGDIQVVPIGVGPHANMQELERISRPIAPIFIRDFETLPREAPDLVLQTCCSKEGLQLPLMYVAAAAFVLLFFVGCGVLLSRKRRRMKLLSSIEQACDICRLKKLKCSKEKPKCAKCLKNNWECRYSPKTKRSPLTRAHLTEVESRLERLEQLFLLIFPREDLDMILKMDSLQDIKALLTGLFVQDNVNKDAVTDRLASVETDMPLTLRQHRISATSSSEESSNKGQRQLTVSAAAGGSGGSGGSDALDDFDLDMLGSDALDDFDLDMLGSDALDDFDLDMLGSDALDDFDLDMLGS

What is claimed is:

1. A chimeric polypeptide comprising, from N terminus to C terminus:
   a) an extracellular domain comprising a first member of a binding pair;
   b) a non-Notch force sensor cleavage domain comprising a proteolytic cleavage site;
   c) a cleavable transmembrane domain; and
   d) an intracellular domain that is not a Notch intracellular signaling domain and does not induce expression of Notch target genes,
   wherein binding of the first member of the specific binding pair to the second member of the specific binding pair, present on a cell or other solid support, induces cleavage at the proteolytic cleavage site thereby releasing the intracellular domain, and
   wherein the non-Notch force sensor cleavage domain is a von Willebrand Factor (vWF) A2 domain.

2. The chimeric polypeptide according to claim 1, wherein the first member of the binding pair comprises at least a portion of a receptor that binds a ligand and the second member of the binding pair comprises at least a portion of the ligand.

3. The chimeric polypeptide according to claim 1, wherein the first member of the binding pair comprises at least a portion of a ligand that binds a receptor and the second member of the binding pair comprises at least a portion of the receptor.

4. The chimeric polypeptide according to claim 1, wherein the first member of the binding pair comprises an antibody.

5. The chimeric polypeptide according to claim 4, wherein the antibody is a nanobody, a diabody, a triabody, or a minibody, a F(ab')$_2$ fragment, a Fab fragment, a single chain variable fragment (scFv) or a single domain antibody (sdAb).

6. The chimeric polypeptide according to claim 1, wherein the intracellular domain comprises a transcriptional activator or repressor.

7. A nucleic acid encoding the chimeric polypeptide according to claim 1.

8. The nucleic acid according to claim 1, wherein the nucleic acid further comprises a transcriptional control element responsive to the released intracellular domain operably linked to a nucleic acid sequence encoding a polypeptide of interest (POI).

9. The nucleic acid according to claim 8, wherein the POI is a heterologous polypeptide selected from the group consisting of: a reporter protein, an immunoactivator, an immune suppression factor, a transcription factor, a site-specific nuclease, a recombinase, a chimeric antigen receptor (CAR), an antibody, a chimeric bispecific binding member, an engineered T cell receptor (TCR) an innate-immune response inducer.

10. A recombinant expression vector comprising the nucleic acid according to claim 1.

11. A method of modulating expression of a heterologous polypeptide in a cell, the method comprising:
  contacting a cell with a second member of a binding pair, wherein the cell expresses a chimeric polypeptide and comprises a sequence encoding the heterologous polypeptide operably linked to a transcriptional control element responsive to the intracellular domain of the chimeric polypeptide, thereby releasing the intracellular domain of the chimeric polypeptide and modulating expression of the heterologous polypeptide, wherein the chimeric polypeptide comprises, from N terminus to C terminus:
    a) an extracellular domain comprising a first member of a binding pair;
    b) a non-Notch force sensor cleavage domain comprising a proteolytic cleavage site;
    c) a cleavable transmembrane domain; and
    d) an intracellular domain that is not a Notch intracellular signaling domain and does not induce expression of Notch target genes,
  wherein binding of the first member of the specific binding pair to the second member of the specific binding pair, present on a cell or other solid support, induces cleavage at the proteolytic cleavage site thereby releasing the intracellular domain, and
  wherein the non-Notch force sensor cleavage domain is a von Willebrand Factor (vWF) A2 domain.

12. The method according to claim 11, wherein the heterologous polypeptide is selected from the group consisting of: a reporter protein, an immunoactivator, an immune suppression factor, a transcription factor, a site-specific nuclease, a recombinase, a chimeric antigen receptor (CAR), an antibody, a chimeric bispecific binding member, an engineered T cell receptor (TCR) an innate-immune response inducer.

13. A method of modulating an activity of a cell that expresses a chimeric polypeptide, the method comprising:
  contacting the cell with a second member of the specific binding pair, wherein binding of the first member of the specific binding pair to the second member of the specific binding pair induces cleavage of the chimeric polypeptide at the proteolytic cleavage site, thereby releasing the intracellular domain, wherein release of the intracellular domain modulates the activity of the cell, wherein the chimeric polypeptide comprises, from N terminus to C terminus:
    a) an extracellular domain comprising a first member of a binding pair;
    b) a non-Notch force sensor cleavage domain comprising a proteolytic cleavage site;
    c) a cleavable transmembrane domain; and
    d) an intracellular domain that is not a Notch intracellular signaling domain and does not induce expression of Notch target genes,
  wherein binding of the first member of the specific binding pair to the second member of the specific binding pair, present on a cell or other solid support, induces cleavage at the proteolytic cleavage site thereby releasing the intracellular domain, and
  wherein the non-Notch force sensor cleavage domain is a von Willebrand Factor (vWF) A2 domain.

14. The method according to claim 13, wherein release of the intracellular domain induces cell death by a mechanism other than apoptosis.

15. The method according to claim 13, wherein release of the intracellular domain modulates gene expression in the cell through transcriptional regulation, chromatin regulation, translation, trafficking or post-translational processing.

16. The method according to claim 13, wherein release of the intracellular domain induces de novo expression or modulates expression of a gene product in the cell.

17. The method according to claim 16, wherein the gene product is a transcriptional activator, a transcriptional repressor, a chimeric antigen receptor, a second chimeric Notch receptor polypeptide, a translation regulator, a cytokine, a hormone, a chemokine, or an antibody.

18. A host cell comprising:
  a) a nucleic acid encoding a chimeric polypeptide according to claim 1; and
  b) a transcriptional control element responsive to the intracellular domain of the chimeric polypeptide operably linked to a nucleic acid encoding a polypeptide of interest (POI).

19. The host cell according to claim 18, wherein the heterologous polypeptide is selected from the group consisting of: a reporter protein, an immunoactivator, an immune suppression factor, a transcription factor, a site-specific nuclease, a recombinase, a chimeric antigen receptor (CAR), an antibody, a chimeric bispecific binding member, an engineered T cell receptor (TCR) an innate-immune response inducer.

20. The host cell according to claim 18, wherein the cell is a T cell, a B cell, a monocyte, a natural killer cell, a dendritic cell, a macrophage, a regulatory T cell, a helper T cell, or a cytotoxic T cell.

21. The method according to claim 11, wherein the vWF A2 domain comprises a sequence having at least 77% identity to SEQ ID NO: 69.

22. The method according to claim 13, wherein the vWF A2 domain comprises a sequence having at least 77% identity to SEQ ID NO: 69.

* * * * *